United States Patent
Joergensen et al.

(10) Patent No.: US 9,803,209 B2
(45) Date of Patent: Oct. 31, 2017

(54) BACTERIAL MUTANTS WITH IMPROVED TRANSFORMATION EFFICIENCY

(71) Applicant: Novozymes A/S, Bagsvaerd (DK)

(72) Inventors: Steen Troels Joergensen, Alleroed (DK); Torsten Bak Regueira, Copenhagen (DK); Brian Kobmann, Herlev (DK); Peter Bjarke Olsen, Copenhagen (DK); Bjarke Christensen, Lyngby (DK)

(73) Assignee: Novozymes A/S, Bagsværd (DE)

( * ) Notice: Subject to any disclaimer, the term of this patent is extended or adjusted under 35 U.S.C. 154(b) by 0 days.

(21) Appl. No.: 14/397,512

(22) PCT Filed: May 17, 2013

(86) PCT No.: PCT/US2013/041588
§ 371 (c)(1),
(2) Date: Oct. 28, 2014

(87) PCT Pub. No.: WO2013/173711
PCT Pub. Date: Nov. 21, 2013

(65) Prior Publication Data
US 2015/0125959 A1    May 7, 2015

Related U.S. Application Data

(60) Provisional application No. 61/648,958, filed on May 18, 2012.

(51) Int. Cl.
C12N 15/74    (2006.01)
C12N 9/10    (2006.01)
C12N 9/22    (2006.01)

(52) U.S. Cl.
CPC ......... *C12N 15/746* (2013.01); *C12N 9/1007* (2013.01); *C12N 9/22* (2013.01)

(58) Field of Classification Search
None
See application file for complete search history.

(56) References Cited

U.S. PATENT DOCUMENTS

2014/0134691 A1* 5/2014 Olsen ............. C12N 1/20 435/157
2015/0125959 A1* 5/2015 Joergensen .......... C12N 9/1007 435/471

FOREIGN PATENT DOCUMENTS

WO    2009/145838 A2    12/2009
WO    WO 2013/173711 A1 *    11/2013
WO    WO 2014/102180 A1 *    4/2014

OTHER PUBLICATIONS

Frese et al, PLoS Genetics | www.plosgenetics.org, Feb. 2011, vol. 7, Issue 2, e1001314, 16 pages.*
Heavens et al, Journal of Bacteriology, Aug. 2011, p. 4015-4016 vol. 193, No. 15.*
Wemhoff et al., Appl. Microbiol. Biotechnol., vol. 97, pp. 7805-7819 (2013).
Accetto et al., FEMS Microbiology Letters, vol. 247, pp. 177-183 (2005).
Altermann et al., Genes Nutr., vol. 6, No. 3, pp. 319-340 (2010).
Bair et al., J. Mol. Biol., vol. 366, pp. 768-778 (2007).
Briggs et al., Applied and Environmental Microbiology, vol. 60, No. 6, pp. 2006-2010 (1994).
Callanan et al., UniProt Accession No. A8YW16 (2008).
Corvaglia et al., PNAS, vol. 107, No. 26, pp. 11954-11958 (2010).
Hashiba et al., Agric. Biol. Chem., vol. 54, No. 6, pp. 1537-1541 (1990).
Jeltsch, Gene, vol. 317, pp. 13-16 (2003).
Mason et al., Journal of Microbiological Methods, vol. 60, No. 3, pp. 353-363 (2005).
Monk et al., mBio, vol. 3, Issue 2, pp. 1-11 (2012).
Qin et al., UniProt Accession No. C0Z063 (2009).
Roberts et al., Nucleic Acids Research, vol. 31, No. 7, pp. 1805-1812 (2003).
Serror et al., Applied and Environmental Microbiology, vol. 68, No. 1, pp. 46-52 (2002).
Tock et al., Current Opinion in Microbiology, vol. 8, pp. 466-472 (2005).
Anonymous, GenBank Accession No. BAG25335.1 (2008).
Anonymous, GenBank Accession No. BAG25859.1 (2008).
Anonymous, GenBank Accession No. BAG25860.1 (2008).
Anonymous, GenBank Accession No. BAG25862.1 (2008).
Anonymous, GenBank Accession No. ABQ82444.1 (2011).
Anonymous, GenBank Accession No. ABQ82473.1 (2011).
Anonymous, GenBank Accession No. EGC15146.1 (2011).
Anonymous, GenBank Accession No. EGC15148.1 (2011).
Anonymous, GenBank Accession No. EGC15149.1 (2011).

* cited by examiner

*Primary Examiner* — Nita M Minnifield
(74) *Attorney, Agent, or Firm* — Eric J Fechter

(57) ABSTRACT

Provided herein are *Lactobacillus* mutants having improved transformation efficiency, comprising a disruption to an endogenous gene encoding a restriction modification system protein. Also described are methods for producing the mutants, methods for generating transformants using the mutants, and methods for producing a polypeptide or fermentation product using the mutants.

20 Claims, 9 Drawing Sheets

SJ10655 MIYKYLGDIAEIKGGKRMPKGTRLQQEKNQHPYLRITDYDGKSFDRNSIRYVPDEVFEKI
        ::::::::::::::::::::::::::::::::::::::::::::::::::::::::::::
SJ11400 MIYKYLGDIAEIKGGKRMPKGTRLQQEKNQHPYLRITDYDGKSFDRNSIRYVPDEVFEKI

SJ10655 SNYTVTEGDIFLSIVGTIGIATTIDKEYDNANLTENAVKIIPDESVNSKYILYFLQSMLG
        ::::::::::::::::::::::::::::::::::::::::::::::::::::::::::::
SJ11400 SNYTVTEGDIFLSIVGTIGIATTIDKEYDNANLTENAVKIIPDESVNSKYILYFLQSMLG

SJ10655 QRQMNELSVGSTQKKLPIKNIKKIKILLPNLEIQNKVVSNLQILDKKIALNNQINDNLDA
        :::::::::::::::::::::::::::::::::::::::: :::::::::::::::::::
SJ11400 QRQMNELSVGSTQKKLPIKNIKKIKILLPNLEIQNKVVSNL*ILDKKIALNNQINDNLDA

SJ10655 LLTNIFKKYMINDGFEKSNLTQIANYKNGLAMQKYRPNSNEESLPVLKIKELNQGNTDDS
        ::::::::::::::::::::::::::::::::::::::::::::::::::::::::::::
SJ11400 LLTNIFKKYMINDGFEKSNLTQIANYKNGLAMQKYRPNSNEESLPVLKIKELNQGNTDDS

SJ10655 SDRCSANLDNSVIVNTGDIIFSWSGTLLVKNWTGDKAGLNQHLFKVTSNKYPAWFIYEWT
        ::::::::::::::::::::::::::::::::::::::::::::::::::::::::::::
SJ11400 SDRCSANLDNSVIVNTGDIIFSWSGTLLVKNWTGDKAGLNQHLFKVTSNKYPAWFIYEWT

SJ10655 KYHLLRFQAIAAGKATTMGHIKRSDLKSSLVYIPSQLFLAKMDSQLAPIYSQRLNLIKEN
        ::::::::::::::::::::::::::::::::::::::::::::::::::::::::::::
SJ11400 KYHLLRFQAIAAGKATTMGHIKRSDLKSSLVYIPSQLFLAKMDSQLAPIYSQRLNLIKEN

SJ10655 QQLSKLKQTLLKKYF
        :::::::::::::::
SJ11400 QQLSKLKQTLLKKYF

Fig. 1

```
JMC1112  MEYKKFTALFTDVTKTGTKIPKDEYLTTGKNIIIDQGKDSIAGYTDRQKGIFEEVPVIVF
         ::::::::::::::::::::::::::::::::::::::::::::::::::::::::::::
SJ10655  MEYKKFTALFTDVTKTGTKIPKDEYLTTGKNIIIDQGKDSIAGYTDRQKGIFEEVPVIVF

JMC1112  GDHTRIVKYIDKPFFLGADGVKVLKSKEKESNYKYLYYALKAAHIPNTGYNRHFKWLKQI
         ::::::::::::::::::::::::::::::::::::::::::::::::::::::::::::
SJ10655  GDHTRIVKYIDKPFFLGADGVKVLKSKEKESNYKYLYYALKAAHIPNTGYNRHFKWLKQI

JMC1112  NMNYPDLNEQKNIVDILDSLTRIIKVRQKELAFFDKLIKARFVEMFGDPISNKKSWKKRL
         ::::::::::::::::::::::::::::::::::::::::::::::::::::::::::::
SJ10655  NMNYPDLNEQKNIVDILDSLTRIIKVRQKELAFFDKLIKARFVEMFGDPISNKKSWKKRL

JMC1112  LNDLVDKIGSGATPKGGKESYQDHGISFIRSMNVHDGYFNYKDLAYINSTQAKQLSNVIV
         ::::::::::::::::::::::::::::::::::::::::::::::::::::::::::::
SJ10655  LNDLVDKIGSGATPKGGKESYQDHGISFIRSMNVHDGYFNYKDLAYINSTQAKQLSNVIV

JMC1112  QSQDVFINITGASVARSCIVPDDILPARVNQHVSIIRCKSDVLNPIFINNLFLNDSFKRI
         ::::::::::::::::::::::::::::::::::::::::::::::::::::::::::::
SJ10655  QSQDVFINITGASVARSCIVPDDILPARVNQHVSIIRCKSDVLNPIFINNLFLNDSFKRI

JMC1112  LLSIGLSGGATRQAITKKQLEMLKIILPPISLQNEYANFVHQVDKSKFENIVYLNKTLLN
         ::::::::::::::::::::::::::::::::::::::::::::::   :  ..:..:
SJ10655  LLSIGLSGGATRQAITKKQLEMLKIILPPISLQNEYANFVHQVDKSK----VVIQKSLDE

JMC1112  KILSQIGDVIRD

SJ10655  TQKLYDSLMQEYFG
```

Fig. 2

```
JMC1112  MIVKLKDVCIKGTSNIRQKDVNDSGRYPVYGAAGPVGFMNSFQYDEPYVGVVKDGAGIGR
         ::::::::::::::::::::::::::::::::::::::::::::::::::::::::::
SJ10655   VKLKDVCIKGTSNIRQKDVNDSGRYPVYGAAGPVGFMNSFQYDEPYVGVVKDGAGIGR

JMC1112  ATYLPSNSSIIGTMQALIPKKNVLPKYLYYAVSSMHLEKYYSGATIPHIYFKNYKHERFV
         ::::::::::::::::::::::::::::::::::::::::::::::::::::::::::::
SJ10655  ATYLPSNSSIIGTMQALIPKKNVLPKYLYYAVSSMHLEKYYSGATIPHIYFKNYKHERFV

JMC1112  LVSKKEQEQIIWRFSLLEKMISNKQQQLLKLDELIKARFVEMFGDPIINNKNIKKKKLGD
         ::::::::::::::::::::::::::::::::::::::::::::::::::::::::::::
SJ10655  LVSKKEQEQIIWRFSLLEKMISNKQQQLLKLDELIKARFVEMFGDPIINNKNIKKKKLGD

JMC1112  ICLLKAGDFTPSKKISPVKTSINKYPCFGGNGIRGYVDNYTHQGNYSLIGRQGALCGNVK
         ::::::::::::::::::::::::::::::::::::::::::::::::::::::::::::
SJ10655  ICLLKAGDFTPSKKISPVKTSINKYPCFGGNGIRGYVDNYTHQGNYSLIGRQGALCGNVK

JMC1112  FATGKFRNTEHAILVSPNIEINSRWLFELLNLEKLNRFRSGAAQPGLAVKTLNEIIVPVA
         ::::::::::::::::::::::::::::::::::::::::::::::::::::::::::::
SJ10655  FATGKFRNTEHAILVSPNIEINSRWLFELLNLEKLNRFRSGAAQPGLAVKTLNEIIVPVA

JMC1112  DLNSQNEYANFVQQVDKSK----VVIQKSLDETQKLYDSLMQEYFG
         ::::::::::::::::::::    : ..:.:
SJ10655  DLNSQNEYANFVQQVDKSKFENIVYLNKTLLNKILSQIGDVIRD
```

Fig. 3

BACTERIAL MUTANTS WITH IMPROVED TRANSFORMATION EFFICIENCY

CROSS-REFERENCE TO RELATED APPLICATIONS

This application is a 35 U.S.C. 371 national application of PCT/US2013/041588 filed May 17, 2013 which claims priority or the benefit under 35 U.S.C. 119 of U.S. provisional application No. 61/648,958 filed May 18, 2012 the contents of which are fully incorporated herein by reference.

REFERENCE TO A SEQUENCE LISTING

This application contains a Sequence Listing in computer readable form, which is incorporated herein by reference.

BACKGROUND

DNA that is recognized as foreign to a given cell may be targeted for degradation within the cell, either by its lack of a host-like methylation pattern or by the presence of unusual base modifications relative to the host DNA (Bair and Black, 2007, *J Mol Biol* 366: 768-778). The subsequent degradation by restriction endonucleases reportedly constitutes effective barriers to the introduction of DNA into bacteria (Briggs et al. *Appl. Environ. Microbiol.* 1994, 60, 2006-2010; Accetto et al. *FEMS Microbiol. Lett.* 2005, 247, 177-183; Bair and Black, *J. Mol. Biol.* 2007, 366, 768-778; Corvaglia et al. *Proc. Natl. Acad. Sci. U.S.A.* 2010, 107, 11954-11958; Monk et al., 2012, mBio 3(2): e00277-11.doi: 10.1128/mBio.00277-11).

These nuclease-based systems are grouped into four main types, type I to type IV, by a number of criteria (Roberts et al. *Nucleic Acids Res.* 2003, 31, 1805-1812). Systems of type I to type III encompass paired methyltransferase and endonuclease activities, degrading foreign DNA that lacks the proper methylation pattern, whereas the type IV enzymes are endonucleases that only cleave DNA substrates that have been modified (Tock and Dryden, *Curr. Opin. Microbiol.* 2005, 8, 466-472).

Bacterial transformants provide a key platform for a variety of industrially relevant processes, such as metabolic engineering and biochemical production. However, the introduction of foreign DNA into some bacterial hosts, e.g., *Lactobacillus*, can be an inefficient process, resulting in few, if any, transformants. There is a need in the art for new methods of introducing a DNA into bacterial host cells to improve the efficiency of obtaining transformants. The present invention fulfills these and other needs.

SUMMARY

Described herein are isolated *Lactobacillus* mutants having improved transformation efficiency. In one aspect is a mutant of a parent *Lactobacillus* strain, comprising a disruption to an endogenous gene encoding a type I restriction modification system subunit (e.g., restriction subunit or specificity subunit), wherein the mutant has improved transformation efficiency compared to the parent *Lactobacillus* strain when cultivated under identical conditions. In some aspects, the *Lactobacillus* mutant is a *Lactobacillus reuteri* mutant.

Also described are methods for obtaining the *Lactobacillus* mutants, comprising disrupting in a parent *Lactobacillus* strain an endogenous gene encoding the type I restriction modification system subunit (e.g., restriction subunit or specificity subunit).

Also described are methods for obtaining a *Lactobacillus* transformant, comprising transforming a heterologous polynucleotide into the *Lactobacillus* mutant.

Also described are methods of producing a polypeptide, comprising: (a) cultivating a *Lactobacillus* transformant comprising a heterologous polynucleotide encoding the polypeptide; and (b) recovering the polypeptide.

Also described are methods of producing a fermentation product, comprising: (a) cultivating the *Lactobacillus* transformant comprising a heterologous polynucleotide encoding a polypeptide of the fermentation pathway; and (b) recovering the fermentation product. In some aspects, the fermentation product is propanol (n-propanol or isopropanol).

BRIEF DESCRIPTION OF THE FIGURES

FIG. 1 shows an alignment of a restriction modification system specificity domain LAR0818 (SEQ ID NO: 2) from *L. reuteri* SJ10655 compared to the corresponding mutated specificity domain from *L. reuteri* SJ11400.

FIG. 2 shows an alignment of a restriction modification system specificity domain LAR1344 (SEQ ID NO: 14) from *L. reuteri* JCM1112 compared to the corresponding specificity domain from *L. reuteri* SJ10655.

FIG. 3 shows an alignment of a restriction modification system specificity domain LAR1346 (SEQ ID NO: 12) from *L. reuteri* JCM1112 compared to the corresponding specificity domain from *L. reuteri* SJ10655.

DEFINITIONS

Figure 4:
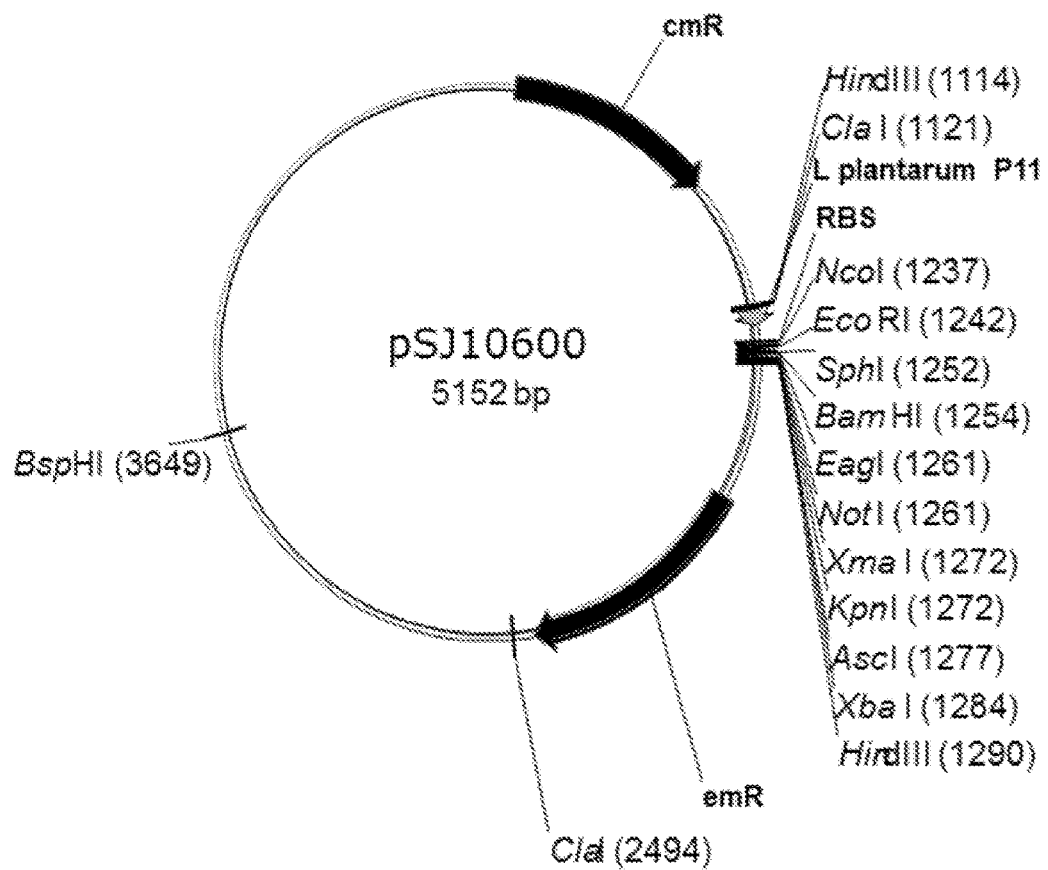
FIG. 4 shows a plasmid map for pSJ10600.

Disruption: The term "disruption" means that a coding region and/or control sequence of a referenced gene is partially or entirely modified (such as by deletion, insertion, and/or substitution of one or more nucleotides, or by association with RNAi or antisense technology) resulting in the absence (inactivation) or decrease in expression, and/or the absence or decrease of enzyme activity of the encoded polypeptide. The effects of disruption can be measured using techniques known in the art such as detecting the absence or decrease of enzyme activity using from cell-free extract measurements referenced herein; or by the absence or decrease of corresponding mRNA (e.g., at least 25% decrease, at least 50% decrease, at least 60% decrease, at least 70% decrease, at least 80% decrease, or at least 90% decrease); the absence or decrease in the amount of corresponding polypeptide having enzyme activity (e.g., at least 25% decrease, at least 50% decrease, at least 60% decrease, at least 70% decrease, at least 80% decrease, or at least 90% decrease); or the absence or decrease of the specific activity of the corresponding polypeptide having enzyme activity (e.g., at least 25% decrease, at least 50% decrease, at least 60% decrease, at least 70% decrease, at least 80% decrease, or at least 90% decrease). Disruptions of a particular gene of interest can be generated by methods known in the art, e.g., by directed homologous recombination (see *Methods in Yeast Genetics* (1997 edition), Adams, Gottschling, Kaiser, and Stems, Cold Spring Harbor Press (1998)).

Parent: The term "parent" or "parent *Lactobacillus* strain" means a *Lactobacillus* strain to which a disruption is made to produce a mutant *Lactobacillus* strain described herein. The parent may be a naturally occurring (wild-type) or previously modified *Lactobacillus* strain.

Mutant: The term "mutant" means the resulting *Lactobacillus* strain after a disruption is made to a parent *Lactobacillus* strain.

Type I restriction modification system: The term "type I restriction modification system" means a multifunctional enzyme complex comprising at least one restriction subunit (HsdR), at least one modification subunit (HsdM) and at least one specification subunit (HsdS), wherein the complex exerts endonuclease and methyltransferase activity (see Murray, *Microbiol. Mol. Biol. Rev.* 2000, 64: 412-434).

The HsdR subunit includes the active site for ATP hydrolysis and other sequences essential for endonuclease activity. The HsdM subunit includes the active site for DNA methylation and the binding site for AdoMet (S-Adenosylmethionine). The HsdS subunit includes two target recognition domains that impart target sequence specificity to both the restriction and modification activities of the complex.

Improved transformation efficiency: The term "improved transformation efficiency" means that the referenced *Lactobacillus* mutant strain is capable of generating an increased number of transformants compared to the parent *Lactobacillus* strain when transformed and cultivated under identical conditions. Improved transformation efficiency can be demonstrated by generating an increased number of transformants using electroporation as described in the Examples below with at least one suitable DNA, such as any of the plasmids referenced herein (e.g., pSJ10762, pTRGU1065, pTRGU1073). In some aspects, the *Lactobacillus* mutant strain is capable of producing at least 2-fold, e.g., at least 5-fold, at least 10-fold, at least 20-fold, at least 50-fold, at least 100-fold, at least 200-fold, at least 500-fold, at least 1000-fold, at least 2000-fold, at least 5000-fold, at least 10000-fold, at least 20000-fold, at least 50000-fold, or at least 100000-fold more transformants compared to the parent *Lactobacillus* strain.

Isolated: The term "isolated" means a referenced substance in a form or environment that does not occur in nature. Non-limiting examples of isolated substances include (1) any non-naturally occurring substance, (2) any substance including, but not limited to, any host cell, enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., recombinant production in a host cell; multiple copies of a gene encoding the substance; and use of a stronger promoter than the promoter naturally associated with the gene encoding the substance).

Mature polypeptide sequence: The term "mature polypeptide sequence" means the portion of the referenced polypeptide sequence after any post-translational sequence modifications (such as N-terminal processing and/or C-terminal truncation). The mature polypeptide sequence may be predicted, e.g., based on the SignalP program (Nielsen et al., *Protein Engineering* 1997, 10, 1-6) or the InterProScan program (The European Bioinformatics Institute). In some instances, the mature polypeptide sequence may be identical to the entire referenced polypeptide sequence. It is known in the art that a host cell may produce a mixture of two of more different mature polypeptide sequences (i.e., with a different C-terminal and/or N-terminal amino acid) expressed by the same polynucleotide.

Coding sequence: The term "coding sequence" means a polynucleotide sequence, which specifies the amino acid sequence of a polypeptide. The boundaries of the coding sequence are generally determined by an open reading frame, which usually begins with the ATG start codon or alternative start codons such as GTG and TTG and ends with a stop codon such as TAA, TAG, and TGA. The coding sequence may be a sequence of genomic DNA, cDNA, a synthetic polynucleotide, and/or a recombinant polynucleotide.

Mature polypeptide coding sequence: The term "mature polypeptide coding sequence" means the portion of the referenced polynucleotide sequence that encodes a mature polypeptide sequence. The mature polypeptide coding sequence may be predicted, e.g., based on the SignalP program (supra) or the InterProScan program (supra). In some instances, the mature polypeptide coding sequence may be identical to the entire referenced polynucleotide sequence.

Sequence Identity: The relatedness between two amino acid sequences or between two nucleotide sequences is described by the parameter "sequence identity".

For purposes described herein, the degree of sequence identity between two amino acid sequences is determined using the Needleman-Wunsch algorithm (Needleman and Wunsch, *J. Mol. Biol.* 1970, 48, 443-453) as implemented in the Needle program of the EMBOSS package (EMBOSS: The European Molecular Biology Open Software Suite, Rice et al., *Trends Genet* 2000, 16, 276-277), preferably version 3.0.0 or later. The optional parameters used are gap open penalty of 10, gap extension penalty of 0.5, and the EBLOSUM62 (EMBOSS version of BLOSUM62) substitution matrix. The output of Needle labeled "longest identity" (obtained using the -nobrief option) is used as the percent identity and is calculated as follows:

(Identical Residues×100)/(Length of Alignment−Total Number of Gaps in Alignment)

For purposes described herein, the degree of sequence identity between two deoxyribonucleotide sequences is determined using the Needleman-Wunsch algorithm (Needleman and Wunsch, 1970, supra) as implemented in the Needle program of the EMBOSS package (EMBOSS: The European Molecular Biology Open Software Suite, Rice et al., 2000, supra), preferably version 3.0.0 or later. The optional parameters used are gap open penalty of 10, gap extension penalty of 0.5, and the EDNAFULL (EMBOSS version of NCBI NUC4.4) substitution matrix. The output of Needle labeled "longest identity" (obtained using the -nobrief option) is used as the percent identity and is calculated as follows:

(Identical Deoxyribonucleotides×100)/(Length of Alignment−Total Number of Gaps in Alignment)

Heterologous polynucleotide: The term "heterologous polynucleotide" is defined herein as a polynucleotide that is not native to the host cell; a native polynucleotide in which one or more (e.g., two, several) structural modifications have been made to the coding region; a native polynucleotide whose expression is quantitatively altered as a result of manipulation of the DNA by recombinant DNA techniques, e.g., a different (foreign) promoter linked to the polynucleotide; or a native polynucleotide whose expression is quantitatively altered by the introduction of one or more extra copies of the polynucleotide into the host cell.

Endogenous gene: The term "endogenous gene" means a gene that is native to the parent *Lactobacillus* strain.

Nucleic acid construct: The term "nucleic acid construct" means a polynucleotide comprising one or more (e.g., two, several) control sequences. The polynucleotide may be single-stranded or double-stranded, and may be isolated from a naturally occurring gene, modified to contain segments of nucleic acids in a manner that would not otherwise exist in nature, or synthetic.

Control sequence: The term "control sequence" means a nucleic acid sequence necessary for polypeptide expression. Control sequences may be native or foreign to the polynucleotide encoding the polypeptide, and native or foreign to each other. Such control sequences include, but are not limited to, a leader sequence, polyadenylation sequence, propeptide sequence, promoter sequence, signal peptide sequence, and transcription terminator sequence. The control sequences may be provided with linkers for the purpose of introducing specific restriction sites facilitating ligation of the control sequences with the coding region of the polynucleotide encoding a polypeptide.

Operably linked: The term "operably linked" means a configuration in which a control sequence is placed at an appropriate position relative to the coding sequence of a polynucleotide such that the control sequence directs the expression of the coding sequence.

Expression: The term "expression" includes any step involved in the production of the polypeptide including, but not limited to, transcription, post-transcriptional modification, translation, post-translational modification, and secretion. Expression can be measured—for example, to detect increased expression—by techniques known in the art, such as measuring levels of mRNA and/or translated polypeptide.

Expression vector: The term "expression vector" means a linear or circular DNA molecule that comprises a polynucleotide encoding a polypeptide and is operably linked to control sequences, wherein the control sequences provide for expression of the polynucleotide encoding the polypeptide. At a minimum, the expression vector comprises a promoter sequence, and transcriptional and translational stop signal sequences.

Host cell: The term "host cell" means any cell type that is susceptible to transformation, transfection, transduction, and the like with a nucleic acid construct or expression vector. The term "host cell" encompasses any progeny of a parent cell that is not identical to the parent cell due to mutations that occur during replication.

Transformation: The term "transformation" means introducing a heterologous polynucleotide into a *Lactobacillus* cell so that the DNA is maintained as a chromosomal integrant or as a self-replicating extra-chromosomal vector. The resulting *Lactobacillus* cell following transformation is described herein as a "transformant."

Allelic variant: The term "allelic variant" means any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Reference to "about" a value or parameter herein includes aspects that are directed to that value or parameter per se. For example, description referring to "about X" includes the aspect "X". When used in combination with measured values, "about" includes a range that encompasses at least the uncertainty associated with the method of measuring the particular value, and can include a range of plus or minus two standard deviations around the stated value.

As used herein and in the appended claims, the singular forms "a," "or," and "the" include plural referents unless the context clearly dictates otherwise. It is understood that the aspects described herein include "consisting" and/or "consisting essentially of" aspects.

Unless defined otherwise or clearly indicated by context, all technical and scientific terms used herein have the same meaning as commonly understood by one of ordinary skill in the art.

DETAILED DESCRIPTION

*Lactobacillus* Mutants

Described herein, inter alia, are mutants of a parent *Lactobacillus* strain, such as isolated mutants, comprising a disruption to an endogenous restriction modification system gene, such as a gene encoding a type I restriction modification system subunit, wherein the mutants have improved transformation efficiency compared to the parent *Lactobacillus* strain when cultivated under identical conditions. As shown in the Examples section below, the Applicant has unexpectedly found that a disruption to an endogenous restriction modification system gene can improve the transformation efficiency of a *Lactobacillus* host. Such disruptions may prevent the transformant DNA from degradation by the host cell's restriction modification system, thereby improving the transformation efficiency and overall usefulness of the host cell for biotechnology applications.

The parent strain of the mutants and related methods may be any *Lactobacillus* strain, such as a wild-type *Lactobacillus* or a mutant thereof. In some aspects, the parent *Lactobacillus* strain is a *Lactobacillus plantarum*, *Lactobacillus fructivorans*, or *Lactobacillus reuteri* strain. In one aspect, the parent strain is a *Lactobacillus plantarum* strain. In another aspect, the parent strain is a *Lactobacillus fructivorans* strain. In another aspect, the parent strain is a *Lactobacillus reuteri* strain.

Additional parent *Lactobacillus* strains contemplated include, but are not limited to, *L. acetotolerans, L. acidifarinae, L. acidipiscis, L. acidophilus, L. agilis, L. algidus, L. alimentarius, L. amylolyticus, L. amylophilus, L. amylotrophicus, L. amylovorus, L. animalis, L. antri, L. apodemi, L. aquaticus, L. arizonensis, L. aviarius, L. bavaricus, L. bifermentans, L. bobalius, L. brevis, L. buchneri, L. bulgaricus, L. cacaonum, L. camelliae, L. capillatus, L. carni, L. casei, L. catenaformis, L. cellobiosus, L. ceti, L. coleohominis, L. collinoides, L. composti, L. concavus, L. confusus, L. coryniformis, L. crispatus, L. crustorum, L. curvatus, L. cypricasei, L. delbrueckii, L. dextrinicus, L. diolivorans, L. divergens, L. durianis, L. equi, L. equicursoris, L. equigenerosi, L. fabifermentans, L. farciminis, L. farraginis, L. ferintoshensis, L. fermentum, L. fornicalis, L. fructivorans, L. fructosus, L. frumenti, L. fuchuensis, L. gallinarum, L. gasseri, L. gastricus, L. ghanensis, L. graminis, L. halotolerans, L. hammesii, L. hamsteri, L. harbinensis, L. hayakitensis, L. helveticus, L. heterohiochii, L. hilgardii, L. homohiochii, L. hordei, L. iners, L. ingluviei, L. intestinalis, L. jensenii, L. johnsonii, L. kalixensis, L. kandleri, L. kefiranofaciens, L. kefiranofaciens, L. kefirgranum, L. kefiri, L. kimchii, L. kisonensis, L. kitasatonis, L. kunkeei, L. lactis, L. leichmannfi, L. lindneri, L. malefermentans, L. mali, L. maltaromicus, L. manihotivorans, L. mindensis, L. minor, L.*

*minutus, L. mucosae, L. murinus, L. nagelii, L. namurensis, L. nantensis, L. nodensis, L. oeni, L. oligofermentans, L. oris, L. otakiensis, L. panis, L. pantheris, L. parabrevis, L. parabuchneri, L. paracasei, L. paracollinoides, L. parafarraginis, L. parakefiri, L. paralimentarius, L. paraplantarum, L. pentosus, L. perolens, L. piscicola, L. plantarum, L. pobuzihii, L. pontis, L. psittaci, L. rapi, L. rennini, L. reuteri, L. rhamnosus, L. rimae, L. rogosae, L. rossiae, L. ruminis, L. saerimneri, L. sakei, L. salivarius, L. sanfranciscensis, L. satsumensis, L. secaliphilus, L. senmaizukei, L. sharpeae, L. siliginis, L. similis, L. sobrius, L. spicheri, L. sucicola, L. suebicus, L. sunkii, L. suntoryeus, L. taiwanensis, L. thailandensis, L. thermotolerans, L. trichodes, L. tucceti, L. uli, L. ultunensis, L. uvarum, L. vaccinostercus, L. vaginalis, L. versmoldensis, L. viridescens, L. vitulinus, L. xylosus, L. yamanashiensis, L. zeae,* and *L. zymae.*

The disrupted gene may be any suitable endogenous gene encoding a type I restriction modification system subunit, such as a restriction subunit of a type I restriction modification system, a specificity subunit of a type I restriction modification system, and/or a modification subunit of a type I restriction modification system.

Examples of target genes include those that encode the *Lactobacillus reuteri* multifunctional enzyme complex comprising a specificity subunit of SEQ ID NO: 2, 4, and/or 6; a restriction subunit of SEQ ID NO: 8; and a modification subunit of SEQ ID NO: 10. Additional targets include genes that encode the *Lactobacillus reuteri* multifunctional enzyme complex comprising a specificity subunit of SEQ ID NO: 12 and/or 14; a restriction subunit of SEQ ID NO: 16; and a modification subunit of SEQ ID NO: 18. Additional examples of target genes include those described herein, such as those depicted in Table 4.

In some aspects, both an endogenous gene encoding a restriction subunit and an endogenous gene encoding a specificity subunit are disrupted. In some aspects, an endogenous gene encoding a restriction subunit is disrupted, an endogenous gene encoding a specificity subunit is disrupted, and an endogenous gene encoding a modification subunit is disrupted.

In some aspect of the mutants and related methods, the disrupted gene is an endogenous gene encoding a specificity subunit of a type I restriction modification system. Examples of endogenous genes encoding the specificity subunit include the *Lactobacillus reuteri* genes having the coding sequences shown in SEQ ID NO: 1, 3, 5, 11, or 13, which encode subunits having the amino acid sequences of SEQ ID NO: 2, 4, 6, 12, and 14, respectively. In some aspects, the endogenous gene encodes a specificity subunit having at least 60%, e.g., at least 70%, at least 75%, at least 80%, at least 85%, at least 90%, at least 95%, at least 97%, at least 98%, at least 99%, or 100% sequence identity to SEQ ID NO: 2, 4, 6, 12, 14, the sequence of any specificity subunit depicted in Table 4, or the mature polypeptide sequence thereof. In some aspects, the endogenous gene encodes a specificity subunit having a sequence that differs by no more than ten amino acids, e.g., by no more than five amino acids, by no more than four amino acids, by no more than three amino acids, by no more than two amino acids, or by one amino acid from SEQ ID NO: 2, 4, 6, 12, 14, or the sequence of any specificity subunit depicted in Table 4. In some aspects, the endogenous gene encodes a specificity subunit comprising or consisting of SEQ ID NO: 2. In some aspects, the endogenous gene encodes a specificity subunit comprising or consisting of the mature polypeptide sequence of SEQ ID NO: 2. In some aspects, the endogenous gene encodes a specificity subunit comprising or consisting of SEQ ID NO: 4. In some aspects, the endogenous gene encodes a specificity subunit comprising or consisting of the mature polypeptide sequence of SEQ ID NO: 4. In some aspects, the endogenous gene encodes a specificity subunit comprising or consisting of SEQ ID NO: 6. In some aspects, the endogenous gene encodes a specificity subunit comprising or consisting of the mature polypeptide sequence of SEQ ID NO: 6. In some aspects, the endogenous gene encodes a specificity subunit comprising or consisting of SEQ ID NO: 12. In some aspects, the endogenous gene encodes a specificity subunit comprising or consisting of the mature polypeptide sequence of SEQ ID NO: 12. In some aspects, the endogenous gene encodes a specificity subunit comprising or consisting of SEQ ID NO: 14. In some aspects, the endogenous gene encodes a specificity subunit comprising or consisting of the mature polypeptide sequence of SEQ ID NO: 14.

In other aspects of the mutants or related methods, the coding sequence of the endogenous gene encoding a specificity subunit has at least 60%, e.g., at least 70%, at least 75%, at least 80%, at least 85%, at least 90%, at least 95%, at least 97%, at least 98%, at least 99%, or 100% sequence identity to SEQ ID NO: 1, 3, 5, 11, 13, any gene sequence encoding a specificity subunit depicted in Table 4, or the mature polypeptide coding sequence thereof. In some aspects, the coding sequence of the endogenous gene comprises or consists of SEQ ID NO: 1. In some aspects, the coding sequence of the endogenous gene comprises or consists of the mature polypeptide coding sequence of SEQ ID NO: 1. In some aspects, the coding sequence of the endogenous gene comprises or consists of SEQ ID NO: 3. In some aspects, the coding sequence of the endogenous gene comprises or consists of the mature polypeptide coding sequence of SEQ ID NO: 3. In some aspects, the coding sequence of the endogenous gene comprises or consists of SEQ ID NO: 5. In some aspects, the coding sequence of the endogenous gene comprises or consists of the mature polypeptide coding sequence of SEQ ID NO: 5. In some aspects, the coding sequence of the endogenous gene comprises or consists of SEQ ID NO: 11. In some aspects, the coding sequence of the endogenous gene comprises or consists of the mature polypeptide coding sequence of SEQ ID NO: 11. In some aspects, the coding sequence of the endogenous gene comprises or consists of SEQ ID NO: 13. In some aspects, the coding sequence of the endogenous gene comprises or consists of the mature polypeptide coding sequence of SEQ ID NO: 13.

In other aspects of the mutants or related methods, the coding sequence of the gene encoding the specificity subunit hybridizes under at least low stringency conditions, medium stringency conditions, medium-high stringency conditions, high stringency conditions, or very high stringency conditions with the full-length complementary strand of SEQ ID NO: 1, 3, 5, 11, 13, or any gene sequence encoding a specificity subunit depicted in Table 4.

In some aspects of the mutants and related methods, the disrupted gene is an endogenous gene encoding a restriction subunit of a type I restriction modification system.

Examples of endogenous genes encoding the restriction subunit include the *Lactobacillus reuteri* genes having the coding sequences shown in SEQ ID NO: 7 and 15, which encode subunits having the amino acid sequences of SEQ ID NO: 8 and 16, respectively. In some aspects, the endogenous gene encodes a restriction subunit having at least 60%, e.g., at least 70%, at least 75%, at least 80%, at least 85%, at least 90%, at least 95%, at least 97%, at least 98%, at least 99%, or 100% sequence identity to SEQ ID NO: 8, SEQ ID NO:

16, the sequence of any restriction subunit depicted in Table 4, or the mature polypeptide sequence thereof. In some aspects, the endogenous gene encodes a restriction subunit having a sequence that differs by no more than ten amino acids, e.g., by no more than five amino acids, by no more than four amino acids, by no more than three amino acids, by no more than two amino acids, or by one amino acid from SEQ ID NO: 8, SEQ ID NO: 16, or the sequence of any restriction subunit depicted in Table 4. In some aspects, the endogenous gene encodes a restriction subunit comprising or consisting of SEQ ID NO: 8. In some aspects, the endogenous gene encodes a restriction subunit comprising or consisting of the mature polypeptide sequence of SEQ ID NO: 8. In some aspects, the endogenous gene encodes a restriction subunit comprising or consisting of SEQ ID NO: 16.

In some aspects, the endogenous gene encodes a restriction subunit comprising or consisting of the mature polypeptide sequence of SEQ ID NO: 16.

In other aspects of the mutants and related methods, the coding sequence of the endogenous gene encoding a restriction subunit has at least 60%, e.g., at least 70%, at least 75%, at least 80%, at least 85%, at least 90%, at least 95%, at least 97%, at least 98%, at least 99%, or 100% sequence identity to SEQ ID NO: 7, SEQ ID NO: 15, any gene sequence encoding a restriction subunit depicted in Table 4, or the mature polypeptide coding sequence thereof. In some aspects, the coding sequence of the endogenous gene comprises or consists of SEQ ID NO: 7. In some aspects, the coding sequence of the endogenous gene comprises or consists of the mature polypeptide coding sequence of SEQ ID NO: 7. In some aspects, the coding sequence of the endogenous gene comprises or consists of SEQ ID NO: 15. In some aspects, the coding sequence of the endogenous gene comprises or consists of the mature polypeptide coding sequence of SEQ ID NO: 15.

In other aspects of the mutants and related methods, the coding sequence of the gene encoding the restriction subunit hybridizes under at least low stringency conditions, medium stringency conditions, medium-high stringency conditions, high stringency conditions, or very high stringency conditions with the full-length complementary strand of SEQ ID NO: 7, SEQ ID NO: 15, or any gene sequence encoding a restriction subunit depicted in Table 4.

In some aspect of the mutants and related methods, the disrupted gene is an endogenous gene encoding a modification subunit of a type I restriction modification system. Examples of endogenous genes encoding the modification subunit include the *Lactobacillus reuteri* genes having the coding sequences shown in SEQ ID NO: 9 and 17, which encode subunits having the amino acid sequences of SEQ ID NO: 10 and 18, respectively. In some aspects, the endogenous gene encodes a modification subunit having at least 60%, e.g., at least 70%, at least 75%, at least 80%, at least 85%, at least 90%, at least 95%, at least 97%, at least 98%, at least 99%, or 100% sequence identity to SEQ ID NO: 10, SEQ ID NO: 18, the sequence of any modification subunit depicted in Table 4, or the mature polypeptide sequence thereof. In some aspects, the endogenous gene encodes a modification subunit having a sequence that differs by no more than ten amino acids, e.g., by no more than five amino acids, by no more than four amino acids, by no more than three amino acids, by no more than two amino acids, or by one amino acid from SEQ ID NO: 10, SEQ ID NO: 18, or the sequence of any modification subunit depicted in Table 4. In some aspects, the endogenous gene encodes a modification subunit comprising or consisting of SEQ ID NO: 10.

In some aspects, the endogenous gene encodes a modification subunit comprising or consisting of the mature polypeptide sequence of SEQ ID NO: 10. In some aspects, the endogenous gene encodes a modification subunit comprising or consisting of SEQ ID NO: 18. In some aspects, the endogenous gene encodes a modification subunit comprising or consisting of the mature polypeptide sequence of SEQ ID NO: 18.

In other aspects of the mutants or related methods, the coding sequence of the endogenous gene encoding a modification subunit has at least 60%, e.g., at least 70%, at least 75%, at least 80%, at least 85%, at least 90%, at least 95%, at least 97%, at least 98%, at least 99%, or 100% sequence identity to SEQ ID NO: 9, SEQ ID NO: 17, any gene sequence encoding a modification subunit depicted in Table 4, or the mature polypeptide coding sequence thereof. In some aspects, the coding sequence of the endogenous gene comprises or consists of SEQ ID NO: 9. In some aspects, the coding sequence of the endogenous gene comprises or consists of the mature polypeptide coding sequence of SEQ ID NO: 9. In some aspects, the coding sequence of the endogenous gene comprises or consists of SEQ ID NO: 17. In some aspects, the coding sequence of the endogenous gene comprises or consists of the mature polypeptide coding sequence of SEQ ID NO: 17.

In other aspects of the mutants or related methods, the coding sequence of the gene encoding the modification subunit hybridizes under at least low stringency conditions, medium stringency conditions, medium-high stringency conditions, high stringency conditions, or very high stringency conditions with the full-length complementary strand of SEQ ID NO: 9, SEQ ID NO: 17, or any gene sequence encoding a modification subunit depicted in Table 4.

In some aspects of the mutants and related methods, the disrupted gene is an endogenous gene encoding a non-type I restriction modification system protein. A non-type I restriction modification system protein as used herein refers to a restriction modification system protein that is not of the type I category (e.g., Type II, Type III, or Type IV). Examples of endogenous genes encoding the non-type I restriction modification system protein include the *Lactobacillus reuteri* genes having the coding sequences shown in SEQ ID NO: 19 and 21, which encode proteins having the amino acid sequences of SEQ ID NO: 20 and 22, respectively. In some aspects, the endogenous gene encodes a protein having at least 60%, e.g., at least 70%, at least 75%, at least 80%, at least 85%, at least 90%, at least 95%, at least 97%, at least 98%, at least 99%, or 100% sequence identity to SEQ ID NO: 20, SEQ ID NO: 22, or the mature polypeptide sequence thereof. In some aspects, the endogenous gene encodes a protein having a sequence that differs by no more than ten amino acids, e.g., by no more than five amino acids, by no more than four amino acids, by no more than three amino acids, by no more than two amino acids, or by one amino acid from SEQ ID NO: 20 or SEQ ID NO: 22. In some aspects, the endogenous gene encodes a protein comprising or consisting of SEQ ID NO: 20. In some aspects, the endogenous gene encodes a protein comprising or consisting of the mature polypeptide sequence of SEQ ID NO: 22. In some aspects, the endogenous gene encodes a protein comprising or consisting of SEQ ID NO: 20. In some aspects, the endogenous gene encodes a protein comprising or consisting of the mature polypeptide sequence of SEQ ID NO: 22.

In other aspects of the mutants and related methods, the coding sequence of the endogenous gene has at least 60%, e.g., at least 70%, at least 75%, at least 80%, at least 85%, at least 90%, at least 95%, at least 97%, at least 98%, at least 99%, or 100% sequence identity to SEQ ID NO: 19, SEQ ID NO: 21, or the mature polypeptide coding sequence thereof. In some aspects, the coding sequence of the endogenous gene comprises or consists of SEQ ID NO: 19. In some aspects, the coding sequence of the endogenous gene comprises or consists of the mature polypeptide coding sequence of SEQ ID NO: 19. In some aspects, the coding sequence of the endogenous gene comprises or consists of SEQ ID NO: 21. In some aspects, the coding sequence of the endogenous gene comprises or consists of the mature polypeptide coding sequence of SEQ ID NO: 21.

In other aspects of the mutants and related methods, the coding sequence of the gene encoding the encoding a non-type I restriction modification system protein hybridizes under at least low stringency conditions, medium stringency conditions, medium-high stringency conditions, high stringency conditions, or very high stringency conditions with the full-length complementary strand of SEQ ID NO: 19 or SEQ ID NO: 21.

The polynucleotide sequences disclosed herein, or a subsequences thereof; as well as the amino acid sequences described herein, of or a fragment thereof; may be used to design nucleic acid probes to identify and clone a homologous subunit of a type I restriction modification system from strains of different genera or species according to methods well known in the art. In particular, such probes can be used for hybridization with the DNA from a Lactobacillus species of interest, following standard Southern blotting procedures, in order to identify and isolate the corresponding gene therein. Such probes can be considerably shorter than the entire sequence, e.g., at least 14 nucleotides, at least 25 nucleotides, at least 35 nucleotides, at least 70 nucleotides in lengths. The probes may be longer, e.g., at least 100 nucleotides, at least 200 nucleotides, at least 300 nucleotides, at least 400 nucleotides, at least 500 nucleotides in lengths. Even longer probes may be used, e.g., at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}$P, $^{3}$H, $^{35}$S, biotin, or avidin).

A DNA library prepared from such other strains may be screened for DNA that hybridizes with the probes described above. Genomic or other DNA from such other strains may be separated by agarose or polyacrylamide gel electrophoresis, or other separation techniques. DNA from the libraries or the separated DNA may be transferred to and immobilized on nitrocellulose or other suitable carrier material. In order to identify a clone or DNA that is homologous with the polynucleotide sequences described herein, or a subsequence thereof, the carrier material may be used in a Southern blot. For purposes of the probes described above, hybridization indicates that the polynucleotide hybridizes to a labeled nucleic acid probe corresponding to the polynucleotide sequences, the full-length complementary strand thereof, or a subsequence of the foregoing; under very low to very high stringency conditions. Molecules to which the nucleic acid probe hybridizes under these conditions can be detected using, for example, X-ray film.

For long probes of at least 100 nucleotides in length, very low to very high stringency conditions are defined as prehybridization and hybridization at 42° C. in 5×SSPE, 0.3% SDS, 200 micrograms/mL sheared and denatured salmon sperm DNA, and either 25% formamide for very low and low stringencies, 35% formamide for medium and medium-high stringencies, or 50% formamide for high and very high stringencies, following standard Southern blotting procedures for 12 to 24 hours optimally. The carrier material is finally washed three times each for 15 minutes using 2×SSC, 0.2% SDS at 45° C. (very low stringency), at 50° C. (low stringency), at 55° C. (medium stringency), at 60° C. (medium-high stringency), at 65° C. (high stringency), and at 70° C. (very high stringency).

For short probes of about 15 nucleotides to about 70 nucleotides in length, stringency conditions are defined as prehybridization and hybridization at about 5° C. to about 10° C. below the calculated $T_m$ using the calculation according to Bolton and McCarthy (Proc. Natl. Acad. Sci. USA 1962, 48, 1390) in 0.9 M NaCl, 0.09 M Tris-HCl pH 7.6, 6 mM EDTA, 0.5% NP-40, 1×Denhardt's solution, 1 mM sodium pyrophosphate, 1 mM sodium monobasic phosphate, 0.1 mM ATP, and 0.2 mg of yeast RNA per mL following standard Southern blotting procedures for 12 to 24 hours optimally. The carrier material is finally washed once in 6×SCC plus 0.1% SDS for 15 minutes and twice each for 15 minutes using 6×SSC at 5° C. to 10° C. below the calculated $T_m$.

Homologs of the type I restriction modification system subunits described herein from strains of different genera or species generally have amino acid changes that are of a minor nature, that is conservative amino acid substitutions or insertions that do not significantly affect the folding and/or activity of the protein; small deletions, typically of one to about 30 amino acids; small amino-terminal or carboxyl-terminal extensions, such as an amino-terminal methionine residue; a small linker peptide of up to about 20-25 residues; or a small extension that facilitates purification by changing net charge or another function, such as a poly-histidine tract, an antigenic epitope or a binding domain.

Examples of conservative substitutions are within the group of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, The Proteins, Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly.

Essential amino acids can be identified according to procedures known in the art, such as site-directed mutagenesis or alanine-scanning mutagenesis (Cunningham and Wells, Science 1989, 244, 1081-1085). In the latter technique, single alanine mutations are introduced at every residue in the molecule, and the resultant mutant molecules are tested for activity to identify amino acid residues that are critical to the activity of the molecule. See also, Hilton et al., J. Biol. Chem. 1996, 271, 4699-4708. The active site of the enzyme or other biological interaction can also be determined by physical analysis of structure, as determined by such techniques as nuclear magnetic resonance, crystallography, electron diffraction, or photoaffinity labeling, in conjunction with mutation of putative contact site amino acids. See, for example, de Vos et al., Science 1992, 255, 306-312; Smith et al., J. Mol. Biol. 1992, 224, 899-904; Wlodaver et al., FEBS Lett. 1992, 309, 59-64. The identities of essential amino acids can also be inferred from analysis of identities with other related enzymes.

Single or multiple amino acid substitutions, deletions, and/or insertions can be made and tested using known methods of mutagenesis, recombination, and/or shuffling, followed by a relevant screening procedure, such as those disclosed by Reidhaar-Olson and Sauer, *Science* 1988, 241, 53-57; Bowie and Sauer, *Proc. Natl. Acad. Sci. U.S.A.* 1989, 86, 2152-2156; WO 95/17413; or WO 95/22625. Other methods that can be used include error-prone PCR, phage display (e.g., Lowman et al., *Biochemistry* 1991, 30, 10832-10837; U.S. Pat. No. 5,223,409; WO 92/06204), and region-directed mutagenesis (Derbyshire et al., *Gene* 1986, 46, 145; Ner et al., *DNA* 1988, 7, 127).

Mutagenesis/shuffling methods can be combined with high-throughput, automated screening methods to detect activity of cloned, mutagenized polypeptides expressed by host cells (Ness et al., *Nature Biotechnol.* 1999, 17, 893-896). Mutagenized DNA molecules that encode active enzymes can be recovered from the host cells and rapidly sequenced using standard methods in the art. These methods allow the rapid determination of the importance of individual amino acid residues in a polypeptide.

Disruption of Type I Restriction Modification System Subunit Genes and Methods of Producing *Lactobacillus* Mutants The *Lactobacillus* mutant strains described herein may be constructed by disrupting the referenced gene encoding the Type I restriction modification system subunit using methods well known in the art, including those methods described herein. A portion of the gene can be disrupted such as the coding region or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, but are not limited to, a leader, propeptide sequence, signal sequence, transcription terminator, and transcriptional activator.

The *Lactobacillus* mutant strains may be constructed by gene deletion techniques to eliminate or reduce expression of the gene. Gene deletion techniques enable the partial or complete removal of the gene thereby eliminating their expression. In such methods, deletion of the gene is accomplished by homologous recombination using a plasmid that has been constructed to contiguously contain the 5' and 3' regions flanking the gene.

The *Lactobacillus* mutant strains may also be constructed by introducing, substituting, and/or removing one or more (several) nucleotides in the gene or a control sequence thereof required for the transcription or translation thereof. For example, nucleotides may be inserted or removed for the introduction of a stop codon, the removal of the start codon, or a frame-shift of the open reading frame. Such a modification may be accomplished by site-directed mutagenesis or PCR generated mutagenesis in accordance with methods known in the art. See, for example, Botstein and Shortie, *Science* 1985, 229, 4719; Lo et al., *Proc. Natl. Acad. Sci. U.S.A.* 1985, 81, 2285; Higuchi et al., *Nucleic Acids Res* 1988, 16, 7351; Shimada, *Meth. Mol. Biol.* 1996, 57, 157; Ho et al., *Gene* 1989, 77, 61; Horton et al., *Gene* 1989, 77, 61; and Sarkar and Sommer, *BioTechniques* 1990, 8, 404.

The *Lactobacillus* mutant strains may also be constructed by gene disruption techniques by inserting into the gene a disruptive nucleic acid construct comprising a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a non-functional gene product results. A disrupting construct may be simply a selectable marker gene accompanied by 5' and 3' regions homologous to the gene. The selectable marker enables identification of transformants containing the disrupted gene.

The *Lactobacillus* mutant strains may also be constructed by the process of gene conversion (see, for example, Iglesias and Trautner, *Molecular General Genetics* 1983, 189, 73-76). For example, in the gene conversion method, a nucleotide sequence corresponding to the gene is mutagenized in vitro to produce a defective nucleotide sequence, which is then transformed into the parent *Lactobacillus* strain to produce a defective gene. By homologous recombination, the defective nucleotide sequence replaces the endogenous gene. It may be desirable that the defective nucleotide sequence also comprises a marker for selection of transformants containing the defective gene.

The *Lactobacillus* mutant strains may also be constructed by established anti-sense techniques using a nucleotide sequence complementary to the nucleotide sequence of the gene (Parish and Stoker, *FEMS Microbiol. Lett.* 1997, 154, 151-157). More specifically, expression of the gene by a *Lactobacillus* strain may be reduced or inactivated by introducing a nucleotide sequence complementary to the nucleotide sequence of the gene, which may be transcribed in the strain and is capable of hybridizing to the mRNA produced in the strain. Under conditions allowing the complementary anti-sense nucleotide sequence to hybridize to the mRNA, the amount of protein translated is thus reduced or eliminated.

The *Lactobacillus* mutant strains may also be constructed by established RNA interference (RNAi) techniques (see, for example, WO 2005/056772 and WO 2008/080017).

The *Lactobacillus* mutant strains may be further constructed by random or specific mutagenesis using methods well known in the art, including, but not limited to, chemical mutagenesis (see, for example, Hopwood, *The Isolation of Mutants in Methods in Microbiology* (J. R. Norris and D. W. Ribbons, eds.) pp. 363-433, Academic Press, New York, 1970). Modification of the gene may be performed by subjecting the parent strain to mutagenesis and screening for mutant strains in which expression of the gene has been reduced or inactivated. The mutagenesis, which may be specific or random, may be performed, for example, by use of a suitable physical or chemical mutagenizing agent, use of a suitable oligonucleotide, or subjecting the DNA sequence to PCR generated mutagenesis. Furthermore, the mutagenesis may be performed by use of any combination of these mutagenizing methods.

Examples of a physical or chemical mutagenizing agent suitable for the present purpose include ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the parent strain to be mutagenized in the presence of the mutagenizing agent of choice under suitable conditions, and selecting for mutants exhibiting reduced or no expression of the gene.

A nucleotide sequence homologous or complementary to a gene described herein may be used from other microbial sources to disrupt the corresponding gene in a *Lactobacillus* strain of choice.

In one aspect, the modification of a gene in the *Lactobacillus* mutant is unmarked with a selectable marker. Removal of the selectable marker gene may be accomplished by culturing the mutants on a counter-selection medium. Where the selectable marker gene contains repeats flanking its 5' and 3' ends, the repeats will facilitate the looping out of the selectable marker gene by homologous recombination when the mutant strain is submitted to counter-selection. The selectable marker gene may also be removed by homologous recombination by introducing into the mutant strain a nucleic acid fragment comprising 5' and 3' regions of the defective gene, but lacking the selectable marker gene, followed by selecting on the counter-selection medium. By homologous recombination, the defective gene containing the selectable marker gene is replaced with the nucleic acid fragment lacking the selectable marker gene. Other methods known in the art may also be used.

Also described are methods of producing the *Lactobacillus* mutant described herein. In one aspect is a method for obtaining a *Lactobacillus* mutant described herein, comprising disrupting in a parent *Lactobacillus* strain an endogenous gene encoding the type I restriction modification system subunit. In another aspect is a method for obtaining a *Lactobacillus* mutant described herein, comprising: (a) cultivating a parent *Lactobacillus* strain; (a) disrupting an endogenous gene encoding the type I restriction modification system subunit in a parent *Lactobacillus* strain of (a); and (c) isolating the mutant strain resulting from (b).

Transformed DNA and Related Methods

The *Lactobacillus* mutants described herein are useful for producing *Lactobacillus* transformants. In one aspect is a method of obtaining a *Lactobacillus* transformant, comprising transforming a heterologous polynucleotide into a *Lactobacillus* mutant described herein. In another aspect is a method of obtaining a *Lactobacillus* transformant, comprising: (a) cultivating a *Lactobacillus* mutant described herein; (b) transforming a heterologous polynucleotide into the *Lactobacillus* mutant of (a); and (c) isolating the transformant strain resulting from (b).

The transformed DNA described herein can be any DNA of interest. The DNA may be of genomic, cDNA, semisynthetic, synthetic origin, or any combinations thereof. The DNA may be a heterologous polynucleotide that encodes any polypeptide having biological activity of interest or may be a DNA involved in the expression of the polypeptide having biological activity, e.g., a promoter.

The polypeptide having a biological activity may be any polypeptide of interest. The polypeptide may be native or foreign to the *Lactobacillus* host cell of interest. The polypeptide may be naturally occurring allelic and engineered variations of the below-mentioned polypeptides and hybrid polypeptides.

The term "polypeptide" is not meant herein to refer to a specific length of the encoded product and, therefore, encompasses peptides, oligopeptides, and proteins. The term "polypeptide" also encompasses hybrid polypeptides, which comprise a combination of partial or complete polypeptide sequences obtained from at least two different polypeptides wherein one or more may be foreign to the *Lactobacillus* cell. Polypeptides further include naturally occurring allelic and engineered variations of a polypeptide.

In one aspect, the polypeptide is an antibody, antigen, antimicrobial peptide, enzyme, growth factor, hormone, immunodilator, neurotransmitter, receptor, reporter protein, structural protein, and transcription factor.

In another aspect, the polypeptide is an oxidoreductase, transferase, hydrolase, lyase, isomerase, or ligase. In a most preferred aspect, the polypeptide is an alpha-glucosidase, aminopeptidase, amylase, carbohydrase, carboxypeptidase, catalase, cellulase, chitinase, cutinase, cyclodextrin glycosyltransferase, deoxyribonuclease, esterase, alpha-galactosidase, beta-galactosidase, glucoamylase, glucocerebrosidase, alpha-glucosidase, beta-glucosidase, invertase, laccase, lipase, mannosidase, mutanase, oxidase, pectinolytic enzyme, peroxidase, phospholipase, phytase, polyphenoloxidase, proteolytic enzyme, ribonuclease, transglutaminase, urokinase, or xylanase.

In another aspect, the polypeptide is an albumin, collagen, tropoelastin, elastin, or gelatin.

In another aspect, the polypeptide is a hybrid polypeptide, which comprises a combination of partial or complete polypeptide sequences obtained from at least two different polypeptides wherein one or more may be foreign to the *Lactobacillus* host cell.

In another aspect, the polypeptide is a fused polypeptide in which another polypeptide is fused at the N-terminus or the C-terminus of the polypeptide or fragment thereof. A fused polypeptide is produced by fusing a nucleotide sequence (or a portion thereof) encoding one polypeptide to a nucleotide sequence (or a portion thereof) encoding another polypeptide. Techniques for producing fusion polypeptides are known in the art, and include, ligating the coding sequences encoding the polypeptides so that they are in frame and expression of the fused polypeptide is under control of the same promoter(s) and terminator.

The heterologous polynucleotide encoding a polypeptide of interest may be obtained from any prokaryotic, eukaryotic, or other source. For purposes of the present invention, the term "obtained from" as used herein in connection with a given source shall mean that the polypeptide is produced by the source or by a cell in which a gene from the source has been inserted.

Techniques used to isolate or clone a heterologous polynucleotide encoding a polypeptide of interest are known in the art and include isolation from genomic DNA, preparation from cDNA, or a combination thereof. The cloning of the DNA of interest from such genomic DNA can be effected, e.g., by using the well known polymerase chain reaction (PCR). See, for example, Innis et al., *PCR Protocols: A Guide to Methods and Application*, Academic Press, New York, 1990. The cloning procedures may involve excision and isolation of a desired nucleic acid fragment comprising the nucleic acid sequence encoding the polypeptide, insertion of the fragment into a vector molecule, and incorporation of the recombinant vector into the *Lactobacillus* mutant where multiple copies or clones of the nucleic acid sequence will be replicated. The DNA may be of genomic, cDNA, RNA, semisynthetic, synthetic origin, or any combinations thereof.

A heterologous polynucleotide encoding a polypeptide of interest may be manipulated in a variety of ways to provide for expression of the polypeptide in a mutant *Lactobacillus* strain. Manipulation of the polynucleotide's sequence prior to its insertion into a vector may be desirable or necessary depending on the expression vector. The techniques for modifying polynucleotide sequences utilizing recombinant DNA methods are well known in the art.

A nucleic acid construct comprising a polynucleotide encoding a polypeptide may be operably linked to one or more (several) control sequences capable of directing expression of the coding sequence in a mutant *Lactobacillus* strain of the present invention under conditions compatible with the control sequences.

The control sequence may be an appropriate promoter sequence, a nucleotide sequence that is recognized by a mutant *Lactobacillus* strain of the present invention for expression of the polynucleotide encoding the polypeptide. The promoter sequence contains transcriptional control sequences that mediate expression of the polypeptide. The promoter may be any nucleotide sequence that shows transcriptional activity in the mutant *Lactobacillus* strain, including mutant, truncated, and hybrid promoters, and may be obtained from genes encoding extracellular or intracellular polypeptides either native or foreign to the mutant *Lactobacillus* strain.

Examples of suitable promoters for directing the transcription of the nucleic acid constructs in a mutant *Lactobacillus* strain are the promoters obtained from the *Bacillus amyloliquefaciens* alpha-amylase gene (amyQ), *Bacillus licheniformis* alpha-amylase gene (amyL), *Bacillus licheniformis* penicillinase gene (penP), *Bacillus stearothermophilus* maltogenic amylase gene (amyM), *Bacillus subtilis* levansucrase gene (sacB), *Bacillus subtilis* xylA and xylB genes, *E. coli* lac operon, *E. coli* trc promoter (Egon et al., *Gene* 1988, 69, 301-315), *Streptomyces coelicolor* agarase gene (dagA), and prokaryotic beta-lactamase gene (Villa-Kamaroff et al., *Proc. Natl. Acad. Sci. U.S.A.* 1978, 75, 3727-3731), as well as the tac promoter (DeBoer et al., *Proc. Natl. Acad. Sci. U.S.A.* 1983, 80, 21-25). Further promoters are described in "Useful proteins from recombinant bacteria" in Gilbert et al., *Scientific American* 1980, 242, 74-94; and in Sambrook et al., 1989, supra.

The control sequence may also be a suitable transcription terminator sequence, a sequence recognized by a mutant *Lactobacillus* strain to terminate transcription. The terminator sequence is operably linked to the 3' terminus of the nucleotide sequence encoding the heterologous polypeptide. Any terminator that is functional in a *Lactobacillus* strain may be used.

The control sequence may also be a suitable leader sequence, a nontranslated region of mRNA that is important for translation by a mutant *Lactobacillus* strain. The leader sequence is operably linked to the 5' terminus of the nucleotide sequence encoding the heterologous polypeptide. Any leader sequence that is functional in the mutant *Lactobacillus* strain may be used.

The control sequence may also be a signal peptide coding sequence that codes for an amino acid sequence linked to the amino terminus of a polypeptide and directs the encoded polypeptide into the cell's secretory pathway. The 5' end of the coding sequence of the nucleotide sequence may inherently contain a signal peptide coding sequence naturally linked in translation reading frame with the segment of the coding sequence that encodes the secreted polypeptide. Alternatively, the 5' end of the coding sequence may contain a signal peptide coding sequence that is foreign to the coding sequence. The foreign signal peptide coding sequence may be required where the coding sequence does not naturally contain a signal peptide coding sequence. Alternatively, the foreign signal peptide coding sequence may simply replace the natural signal peptide coding sequence in order to enhance secretion of the polypeptide. However, any signal peptide coding sequence that directs the expressed polypeptide into the secretory pathway of the mutant *Lactobacillus* strain, i.e., secreted into a culture medium, may be used in the present invention.

A recombinant expression vector comprising a nucleotide sequence, a promoter, and transcriptional and translational stop signals may be used for the recombinant production of a polypeptide of interest. The various nucleic acids and control sequences described herein may be joined together to produce a recombinant expression vector that may include one or more (e.g., two, several) convenient restriction sites to allow for insertion or substitution of the nucleotide sequence encoding the polypeptide at such sites. Alternatively, the nucleotide sequence may be expressed by inserting the nucleotide sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the nucleotide sequence. The choice of the vector will typically depend on its compatibility with the mutant *Lactobacillus* strain into which the vector is to be introduced. The vector may be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the mutant *Lactobacillus* strain, is integrated into the genome and replicated together with the chromosome(s) into which it has been integrated. Furthermore, a single vector or plasmid or two or more vectors or plasmids that together contain the total DNA to be introduced into the genome of the mutant *Lactobacillus* strain, or a transposon, may be used.

The vector may contain one or more (e.g., two, several) selectable markers that permit easy selection of transformed mutant *Lactobacillus* strains. A selectable marker is a gene the product of which provides for biocide or viral resistance, resistance to heavy metals, prototrophy to auxotrophs, and the like.

Examples of selectable markers for use in the mutant *Lactobacillus* strain include, but are not limited to, the dal genes from *Bacillus subtilis* or *Bacillus licheniformis*, or markers that confer antibiotic resistance such as ampicillin, chloramphenicol, kanamycin, or tetracycline resistance. Suitable markers for yeast host cells are ADE2, HIS3, LEU2, LYS2, MET3, TRP1, and URA3.

The vectors may contain one or more (e.g., two, several) elements that permit integration of the vector into the *Lactobacillus* genome or autonomous replication of the vector in the cell independent of the genome.

For integration into the genome of the mutant *Lactobacillus* strain, the vector may rely on the polynucleotide's sequence encoding the polypeptide of interest or any other element of the vector for integration into the genome by homologous or nonhomologous recombination. Alternatively, the vector may contain additional nucleotide sequences for directing integration by homologous recombination into the genome of the mutant *Lactobacillus* strain at a precise location(s) in the chromosome(s). To increase the likelihood of integration at a precise location, the integrational elements should preferably contain a sufficient number of nucleic acids, such as 100 to 1,500 base pairs, preferably 400 to 1,500 base pairs, and most preferably 800 to 1,500 base pairs, which have a high degree of identity to the corresponding target sequence to enhance the probability of homologous recombination. The integrational elements may be any sequence that is homologous with the target sequence in the genome of the mutant *Lactobacillus* strain. Furthermore, the integrational elements may be non-encoding or encoding nucleotide sequences. On the other hand, the vector may be integrated into the genome of the mutant *Lactobacillus* strain by non-homologous recombination.

For autonomous replication, the vector may further comprise an origin of replication enabling the vector to replicate autonomously in the mutant *Lactobacillus* strain. The origin of replication may be any plasmid replicator mediating autonomous replication that functions in a cell. The term "origin of replication" or "plasmid replicator" is defined herein as a nucleotide sequence that enables a plasmid or vector to replicate in vivo. Examples of bacterial origins of replication useful in the mutant *Lactobacillus* strain are the origins of replication of plasmids pBR322, pUC19, pACYC177, and pACYC184 permitting replication in *E. coli*, and pUB110, pE194, pTA1060, and pAMβ1 permitting replication in *Bacillus*.

The procedures used to ligate the elements described herein to construct the recombinant expression vectors are well known to one skilled in the art (see, e.g., J. Sambrook, E. F. Fritsch, and T. Maniatis, 1989, *Molecular Cloning, A Laboratory Manual,* 2d edition, Cold Spring Harbor, N.Y.).

The DNA can also be a control sequence, e.g., promoter, for manipulating the expression of a gene of interest. Non-limiting examples of control sequences are described above.

The DNA can further be a nucleic acid construct for inactivating a gene of interest in a *Lactobacillus* cell.

The DNA is not to be limited in scope by the specific examples disclosed above, since these examples are intended as illustrations of several aspects of the invention. Transformation of the DNA into the mutant *Lactobacillus* strains can be conducted using techniques known in the art, such as electroporation as described in the Examples section below.

The transformants described herein can be isolated using standard techniques well-known in the art, including, but not limited to, streak plate isolation, growth in enrichment or selective media, temperature growth selection, filtration, or single cell isolation techniques, such as flow cytometry and microfluidics.

In some aspects of the *Lactobacillus* mutants described herein, the disruption to the endogenous gene encoding the type I restriction modification system subunit is repaired following transformation. Repair of the type I restriction modification system subunit gene reinstates the native protection system which is important for recognizing and degrading foreign DNA that could be a detriment, e.g., to cell stability. As used herein, "repairing the disruption to the endogenous type I restriction modification system subunit gene" means increasing the disrupted gene expression, and/or increasing activity of the encoded polypeptide by the disrupted gene. Increased gene expression and increased activity of the polypeptide encoded by the gene can be carried out using techniques known in the art, as well as those described herein, such as techniques used to directly modify the disrupted gene (e.g., revert the disrupted gene back to its native gene sequence) and/or techniques used to transform the functional gene into the *Lactobacillus* host (e.g. integration of the gene at a different loci in the host genome). Accordingly, in one aspect, the methods of obtaining a *Lactobacillus* transformant described herein further comprise repairing the disruption to the endogenous gene encoding the type I restriction modification system subunit.

Methods of Producing Polypeptides and Fermentation Products

Polypeptides

As mentioned supra, the *Lactobacillus* mutants described herein can increase the efficiency in producing *Lactobacillus* transformants which are useful, e.g., in producing a polypeptide having biological activity. Accordingly, in one aspect is a method of producing a polypeptide having biological activity, comprising: (a) cultivating a *Lactobacillus* host cell transformed with a heterologous polynucleotide encoding the polypeptide under conditions conducive for production of the polypeptide, wherein the *Lactobacillus* host cell is a *Lactobacillus* mutant described herein (e.g., a *Lactobacillus* mutant comprising a disruption to an endogenous gene encoding a type I restriction modification system subunit); and (b) recovering the polypeptide.

In another aspect is a method of producing a polypeptide, comprising: (a) cultivating a *Lactobacillus* transformant described herein (e.g., a *Lactobacillus* mutant described herein transformed with a heterologous polynucleotide encoding the polypeptide); and (b) recovering the polypeptide.

The competent *Lactobacillus* host cells are cultivated in a nutrient medium suitable for production of a polypeptide of interest using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the polypeptide of interest to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). The secreted substance of interest, e.g., polypeptide or fermentation product, can be recovered directly from the medium.

The polypeptide having biological activity may be detected using methods known in the art that are specific for the substance. These detection methods may include use of specific antibodies, high performance liquid chromatography, capillary chromatography, formation of an enzyme product, disappearance of an enzyme substrate, or SDS-PAGE. For example, an enzyme assay may be used to determine the activity of a polypeptide having enzyme activity. Procedures for determining enzyme activity are known in the art for many enzymes (see, for example, D. Schomburg and M. Salzmann (eds.), *Enzyme Handbook,* Springer-Verlag, New York, 1990).

The resulting polypeptide having biological activity may be isolated by methods known in the art. For example, a polypeptide of interest may be isolated from the cultivation medium by conventional procedures including, but not limited to, centrifugation, filtration, extraction, spray-drying, evaporation, or precipitation. The isolated polypeptide may then be further purified by a variety of procedures known in the art including, but not limited to, chromatography (e.g., ion exchange, affinity, hydrophobic, chromatofocusing, and size exclusion), electrophoretic procedures (e.g., preparative isoelectric focusing (IEF), differential solubility (e.g., ammonium sulfate precipitation), or extraction (see, e.g., *Protein Purification,* J.-C. Janson and Lars Ryden, editors, VCH Publishers, New York, 1989).

Fermentation Products

The *Lactobacillus* mutants described herein can be used in metabolic engineering, e.g., in the production of a fermentation product. The increased transformation efficiency for the mutants may provide the tools to use *Lactobacillus* over an existing host, and may permit rapid screening of overexpressed heterologous genes for existing and new metabolic pathways.

"Fermentation" or "fermentation process" refers to any fermentation process or any process comprising a fermentation step. Fermentation processes include fermentation processes used in the consumable alcohol industry (e.g., beer and wine), dairy industry (e.g., fermented dairy products), leather industry, tobacco industry, and specialty or bulk chemical industry.

In one aspect is a method of producing a fermentation product, comprising: (a) cultivating a *Lactobacillus* transformant described herein (e.g., a *Lactobacillus* mutant described herein transformed with one or more heterologous polynucleotides that encode one or more polypeptides of a fermentation pathway) under conditions conducive for production of the fermentation product; and (b) recovering the fermentation product.

The *Lactobacillus* transformant can be any *Lactobacillus* mutant described herein that is transformed with one or more heterologous fermentation pathway genes, resulting in increased production of a desired fermentation product. Metabolic pathway genes and corresponding engineered transformants for fermentation of a variety of desired fermentation products are known in the art, e.g., the production of isopropanol and n-propanol (WO2012/058603), 3-hydroxypropionic acid (WO2005/118719), malic acid (WO2011/028643), 1,4-butanediol (WO2008/115840), 1,3-butanediol (WO2010/127319), 2-butanol (WO2010/144746), THF (WO2010/141920), caprolactam (WO2010129936), hexamethylenediamine (WO2010129936), levulinic acid (WO2010129936), 2/3-hydroxyisobutyric acid (WO2009/135074), methacrylic acid (WO2009/135074), adipic acid (WO2009/151728), butadiene (WO2011/140171), muconate (WO2011/017560) and 4-hydroxybutanal (WO2011/047101) (the contents of these applications are hereby incorporated by reference). The *Lactobacillus* mutants described herein may provide tools to further improve on producing the fermented products in the references above.

Methods for producing a fermentation product may be performed in a fermentable medium comprising any one or more (e.g., two, several) sugars, such as glucose, fructose, sucrose, cellobiose, xylose, xylulose, arabinose, mannose, galactose, and/or soluble oligosaccharides. In some instances, the fermentation medium is derived from a natural source, such as sugar cane, starch, or cellulose, and may be the result of pretreating the source by enzymatic hydrolysis (saccharification).

In addition to the appropriate carbon sources from one or more (e.g., two, several) sugar(s), the fermentable medium may contain other nutrients or stimulators known to those skilled in the art, such as macronutrients (e.g., nitrogen sources) and micronutrients (e.g., vitamins, mineral salts, and metallic cofactors). In some aspects, the carbon source can be preferentially supplied with at least one nitrogen source, such as yeast extract, $N_2$, peptone (e.g., Bacto™ Peptone), or soytone (e.g., Bacto™ Soytone). Nonlimiting examples of vitamins include multivitamins, biotin, pantothenate, nicotinic acid, meso-inositol, thiamine, pyridoxine, para-aminobenzoic acid, folic acid, riboflavin, and Vitamins A, B, C, D, and E. Examples of mineral salts and metallic cofactors include, but are not limited to Na, P, K, Mg, S, Ca, Fe, Zn, Mn, and Cu.

The fermenting microorganism is typically added to the fermentation medium and the fermentation is performed for about 8 to about 96 hours, e.g., about 24 to about 60 hours. The temperature is typically between about 26° C. to about 60° C., e.g., about 32° C. or 50° C., and about pH 3 to about pH 8, e.g., pH 4-5, 6, or 7.

Cultivation may be performed under anaerobic, substantially anaerobic (microaerobic), or aerobic conditions, as appropriate. Briefly, anaerobic refers to an environment devoid of oxygen, substantially anaerobic (microaerobic) refers to an environment in which the concentration of oxygen is less than air, and aerobic refers to an environment wherein the oxygen concentration is approximately equal to or greater than that of the air. Substantially anaerobic conditions include, for example, a culture, batch fermentation or continuous fermentation such that the dissolved oxygen concentration in the medium remains less than 10% of saturation. Substantially anaerobic conditions also includes growing or resting cells in liquid medium or on solid agar inside a sealed chamber maintained with an atmosphere of less than 1% oxygen. The percent of oxygen can be maintained by, for example, sparging the culture with an $N_2/CO_2$ mixture or other suitable non-oxygen gas or gases. In some embodiments, the cultivation is performed under anaerobic conditions or substantially anaerobic conditions.

The methods for producing a fermentation product can employ any suitable fermentation operation mode. For example, batch mode fermentation may be used with a close system where culture media and host microorganism, set at the beginning of fermentation, have no additional input except for the reagents certain reagents, e.g., for pH control, foam control or others required for process sustenance. The process described herein can also be employed in Fed-batch or continuous mode.

The methods for producing a fermentation product may be practiced in several bioreactor configurations, such as stirred tank, bubble column, airlift reactor and others known to those skilled in the art. The methods may be performed in free cell culture or in immobilized cell culture as appropriate. Any material support for immobilized cell culture may be used, such as alginates, fibrous bed, or argyle materials such as chrysotile, montmorillonite KSF and montmorillonite K-10.

A fermentation product can be any substance derived from the fermentation. The fermentation product can be, without limitation, an alcohol (e.g., arabinitol, n-butanol, isobutanol, ethanol, glycerol, methanol, ethylene glycol, 1,3-propanediol [propylene glycol], butanediol, glycerin, sorbitol, and xylitol); an alkane (e.g., pentane, hexane, heptane, octane, nonane, decane, undecane, and dodecane), a cycloalkane (e.g., cyclopentane, cyclohexane, cycloheptane, and cyclooctane), an alkene (e.g. pentene, hexene, heptene, and octene); an amino acid (e.g., aspartic acid, glutamic acid, glycine, lysine, serine, and threonine); a gas (e.g., methane, hydrogen ($H_2$), carbon dioxide ($CO_2$), and carbon monoxide (CO)); isoprene; a ketone (e.g., acetone); an organic acid (e.g., acetic acid, acetonic acid, adipic acid, ascorbic acid, citric acid, 2,5-diketo-D-gluconic acid, formic acid, fumaric acid, glucaric acid, gluconic acid, glucuronic acid, glutaric acid, 3-hydroxypropionic acid, itaconic acid, lactic acid, malic acid, malonic acid, oxalic acid, oxaloacetic acid, propionic acid, succinic acid, and xylonic acid); and polyketide. The fermentation product can also be protein as a high value product.

In a one aspect, the fermentation product is an alcohol. It will be understood that the term "alcohol" encompasses a substance that contains one or more hydroxyl moieties. The alcohol can be any alcohol, including, but not limited to propanol, n-butanol, iso-butanol, isobutanol, ethanol, methanol, arabinitol, butanediol, ethylene glycol, glycerin, glycerol, 1,3-propanediol, sorbitol, or xylitol. See, for example, Gong, et al., 1999, Ethanol production from renewable resources, in *Advances in Biochemical Engineering/Biotechnology*, Scheper, T., ed., Springer-Verlag Berlin Heidelberg, Germany, 65: 207-241; Silveira, M. M., and Jonas, R., *Appl. Microbiol. Biotechnol.* 2002, 59, 400-408; Nigam, P., and Singh, D., *Process Biochemistry* 1995, 30, 117-124; Ezeji, et al., *World Journal of Microbiology and Biotechnology* 2003, 19, 595-603.

In one aspect, the fermentation product is propanol, such as isopropanol and/or n-propanol (see WO2012/058603, the content of which is hereby incorporated by reference).

In another aspect, the fermentation product is an alkane. The alkane can be any unbranched or a branched alkane, including, but not limited to pentane, hexane, heptanes, octane, nonane, decane, undecane, or dodecane.

In another aspect, the fermentation product is a cycloalkane, e.g., cyclopentane, cyclohexane, cycloheptane, or cyclooctane.

In another aspect, the fermentation product is an alkene. The alkene can be any unbranched or a branched alkene, including, but not limited to pentene, hexane, heptene, or octene.

In another aspect, the fermentation product is an amino acid. The amino acid can be any amino acid, including, but not limited to aspartic acid, glutamic acid, glycine, lysine, serine, or threonine. See, for example, Richard, A., and Margaritis, A., *Biotechnol. Bioeng.* 2004, 87, 501-515.

In another preferred aspect, the fermentation product is a gas. The gas can be any gas, including, but not limited to methane, $H_2$, $CO_2$, or CO. See, for example, Kataoka, et al., *Water Science and Technology* 1997, 36, 41-47; and Gunaseelan V. N., *Biomass and Bioenergy*, 1997, 13, 83-114.

In another aspect, the fermentation product is isoprene.

In another aspect, the fermentation product is a ketone. It will be understood that the term "ketone" encompasses a substance that contains one or more ketone moieties. In one aspect, the ketone is acetone.

In another aspect, the fermentation product is an organic acid. The organic acid can be any organic acid, including, but not limited to acetic acid, acetonic acid, adipic acid, ascorbic acid, citric acid, 2,5-diketo-D-gluconic acid, formic acid, fumaric acid. glucaric acid, gluconic acid, glucuronic acid, glutaric acid, 3-hydroxypropionic acid, itaconic acid, lactic acid, malic acid, malonic acid, oxalic acid, propionic acid, succinic acid, or xylonic acid. See, for example, Chen, R., and Lee, Y. Y., *Appl. Biochem. Biotechnol.* 1997, 63-65, 435-448. In some aspects, the fermentation product is an amino acid. The amino acid can be any amino acid, including, but not limited to aspartic acid, glutamic acid, glycine, lysine, serine, or threonine. See, for example, Richard, A., and Margaritis, A., *Biotechnol. Bioeng.* 2004, 87, 501-515.

In another aspect, the fermentation product is polyketide.

Suitable assays to test for the production of the fermentation product can be performed using methods known in the art, as described above for polypeptides. For example, the fermentation product (and other organic compounds, such as side products) can be analyzed by methods such as HPLC (High Performance Liquid Chromatography), GC-MS (Gas Chromatography Mass Spectroscopy) and LC-MS (Liquid Chromatography-Mass Spectroscopy) or other suitable analytical methods using routine procedures well known in the art. The release of the fermentation product in the fermentation broth can also be tested with the culture supernatant. Byproducts and residual sugar in the fermentation medium (e.g., glucose) can be quantified by HPLC using, for example, a refractive index detector for glucose and alcohols, and a UV detector for organic acids (Lin et al., *Biotechnol Bioeng* 2005, 90, 775-779), or using other suitable assay and detection methods well known in the art.

Recovery of the fermentation product from the fermentation medium can be conducted using any procedure known in the art including, but not limited to, chromatography (e.g., size exclusion chromatography, adsorption chromatography, ion exchange chromatography), electrophoretic procedures, differential solubility, distillation, extraction (e.g., liquid-liquid extraction), pervaporation, extractive filtration, membrane filtration, membrane separation, reverse osmosis, ultrafiltration, or crystallization.

The following examples are provided by way of illustration and are not intended to be limiting of the invention.

EXAMPLES

Chemicals used as buffers and substrates were commercial products of at least reagent grade.
Host Strains
*Lactobacillus Reuteri* SJ10655 (O4ZXV)

A strain described as *Lactobacillus reuteri* DSM20016 was obtained from a public strain collection. This strain was subcultured in MRS medium, and an aliquot frozen as SJ10468. SJ10468 was inoculated into MRS medium, propagated without shaking for one day at 37° C., and spread on MRS agar plates to obtain single colonies. After two days of growth at 37° C., a single colony was reisolated on a MRS agar plate, the plate incubated at 37° C. for three days, and the cell growth on the plate was scraped off and stored in the strain collection as SJ10655 (alternative name: O4ZXV).

The same cell growth was used to inoculate a 10 ml MRS culture, which was incubated without shaking at 37° C. for 3 days, whereafter cells were harvested by centrifugation and genomic DNA was prepared using a QIAamp DNA Blood Kit (Qiagen, Hilden, Germany) and sent for genome sequencing.

The genome sequence revealed that the isolate SJ10655 (O4ZXV) has a genome essentially identical to that of JCM1112, rather than to that of the closely related strain DSM20016. JCM1112 and DSM20016 are derived from the same original isolate, *L. reuteri* F275 (Morita et al. DNA research, 2008, 15, 151-161.)

*Escherichia coli* SJ2 (see Diderichsen et al. *J. Bacteriol.* 1990, 172, 4315-4321).

*Escherichia coli* MG1655 (see Blattner et al. *Science* 1997, 277, 1453-1462).

*Escherichia coli* TG 1

TG1 is a commonly used cloning strain and was obtained from a commercial supplier; it has the following genotype: F'[traD36 lacIq Δ(lacZ) M15 proA+B+] glnV (supE) thi-1 Δ(mcrB-hsdSM)5 (rK-mK-McrB-) thi Δ(lac-proAB).
Media LB plates were composed of 37 g LB agar (Sigma cat no. L3027) and double distilled water to 1 L.

LBPGS plates were composed of 37 g LB agar (Sigma cat no. L3027), 0.5% starch (Merck cat. no. 101252), 0.01 M $K_2PO_4$, 0.4% glucose, and double distilled water to 1 L.

TY bouillon medium was composed of 20 g tryptone (Difco cat no. 211699), 5 g yeast extract (Difco cat no. 212750), $7*10^{-3}$ g ferrochloride, $1*10^{-3}$ g manganese(II)-chloride, $1.5*10^{-3}$ g magnesium sulfate, and double distilled water to 1 L.

Minimal medium (MM) was composed of 20 g glucose, 1.1 g $KH_2PO_4$, 8.9 g $K_2HPO_4$; 1.0 g $(NH_4)_2SO_4$; 0.5 g Na-citrate; 5.0 g $MgSO_4.7H_2O$; 4.8 mg $MnSO_4.H_2O$; 2 mg thiamine; 0.4 mg/L biotin; 0.135 g $FeCl_3.6H_2O$; 10 mg $ZnCl_2.4H_2O$; 10 mg $CaCl_2.6H_2O$; 10 mg $Na_2MoO_4.2H_2O$; 9.5 mg $CuSO_4.5H_2O$; 2.5 mg $H_3BO_3$; and double distilled water to 1 L, pH adjusted to 7 with HCl.

MRS medium was obtained from Difco™, as either Difco™ Lactobacilli MRS Agar or Difco™ Lactobacilli MRS Broth, having the following compositions-Difco™ Lactobacilli MRS Agar: Proteose Peptone No. 3 (10.0 g), Beef Extract (10.0 g), Yeast Extract (5.0 g), Dextrose (20.0 g), Polysorbate 80 (1.0 g), Ammonium Citrate (2.0 g), Sodium Acetate (5.0 g), Magnesium Sulfate (0.1 g), Manganese Sulfate (0.05 g), Dipotassium Phosphate (2.0 g), Agar (15.0 g) and water to 1 L. Difco™ Lactobacilli MRS Broth: Consists of the same ingredients without the agar.

LC (*Lactobacillus* Carrying) medium (LCM) was composed of Trypticase (10 g), Tryptose (3 g), Yeast extract (5 g), $KH_2PO_4$ (3 g), Tween 80 (1 ml), sodium-acetate (1 g), ammonium citrate (1.5 g), Cystein-HCl (0.2 g), $MgSO_4.7H_2O$ (12 mg), $FeSO_4.7H_2O$ (0.68 mg), $MnSO_4.2H_2O$ (25 mg), and double distilled water to 1 L, pH adjusted to 7.0. Sterile glucose was added after autoclaving to 1% (5 ml of a 20% glucose stock solution/100 ml medium).

Example 1: Transformation Protocols

*Lactobacillus* Strains

Unless noted otherwise, plasmid DNA constructed in *E. coli* was purified from 2 ml of an overnight culture grown in TY medium, and supplemented with appropriate antibiotics using a QIAprep Spin Miniprep Kit (Qiagen, Hilden, Germany) as described by the manufacturer. The plasmid DNA was recovered in a volume of 50 microliters, and one microliter of this plasmid preparation was used for electroporation of *Lactobacillus*.

Plasmid DNA was transformed into *Lactobacillus* strains by electroporation. The *L. reuteri* strains were prepared for electroporation as follows: The strain was inoculated from a frozen stock culture into LCM medium, and incubated without shaking at 37° C. overnight. A 5 ml aliquot was transferred into 500 ml LCM medium and incubated at 37° C. without shaking until $OD_{600}$ reached approximately 0.8. The cells were harvested by centrifugation as above, resuspended and washed 2 times in 50 ml of ion-exchanged sterile water at room temperature, and harvested by centrifugation. The cells were finally gently resuspended in 2.5 ml of 30% PEG1500, and 50 microliter aliquots were quickly frozen in an alcohol/dry ice bath, and stored at −80° C. until use. Variations to the electroporation procedures below are described in the respective examples.

Electroporation procedure A: The frozen cells were thawed on ice, and 2 microliter of a DNA suspension in TE buffer was added. 40 microliters of the mixture was transferred to an ice-cold 2 mm electroporation cuvette, kept on ice for 1-3 minutes, and electroporation carried out in a BioRad Gene Pulser™ with a setting of 1.5 kV; 25 micro-Farad; 400 Ohms. 500 microliter of LCM was added, and the mixture incubated without shaking for 2 hours at 37° C. before plating. Cells were plated on either LCM agar plates (LCM medium solidified with % agar) or MRS agar plates, supplemented with the required antibiotics, and incubated in an anaerobic chamber (Oxoid; equipped with Anaerogen sachet).

Electroporation procedure B: The frozen cells were thawed on ice, and 1 microliter of a DNA suspension in TE buffer was added. 40 microliters of the mixture was transferred to an ice-cold 1 mm electroporation cuvette, kept on ice for 1-3 minutes, and electroporation carried out in a BioRad Gene Pulser™ with a setting of 1.2 kV; 25 micro-Farad; 400 Ohms. 500 microliter of LCM was added, and the mixture incubated without shaking for 4 hours at 37° C. before plating on MRS agar plates, supplemented with the required antibiotics, and incubation in an anaerobic chamber.

*E. Coli* Strains

Transformation of *E. coli* was conducted by electroporation using either a BioRad Gene Pulser™ (BioRad, Hercules, Calif., USA) as described by the manufacturer, or by using chemically competent cells prepared following ordinary textbook procedures commonly known in the art.

Example 2

Plasmid Construction
pSJ10600

A set of constitutive expression vectors were constructed based on the plasmid pVS2 (von Wright et al., *Appl. Environ. Microbiol.* 1987, 53, 1584-1588) and promoters described by Rud et al. (Rud et al. *Microbiology* 2006, 152, 1011-1019). A DNA fragment containing the P11 promoter with a selection of flanking restriction sites, and another fragment containing P27 with a selection of flanking restriction sites, was chemically synthesized by Geneart AG (Regenburg, Germany).

The DNA fragment containing P11 with flanking restriction sites, and the DNA fragment containing P27 with flanking restriction sites are shown in SEQ ID NOs: 506 and 507, respectively. Both DNA fragments were obtained in the form of DNA preparations, where the fragments had been inserted into the standard Geneart vector, pMA. The vector containing P11 was transformed into *E. coli* SJ2 cells, and a transformant kept as SJ10560, containing plasmid pSJ10560. The vector containing P27 was transformed into *E. coli* SJ2 cells, and a transformant kept as SJ10561, containing plasmid pSJ10561.

The promoter-containing fragments, in the form of 176 bp HindIII fragments, were excised from the Geneart vectors and ligated to HindIII-digested pUC19. The P11-containing fragment was excised from the vector prepared from SJ10560, ligated to pUC19, and correct transformants of *E. coli* SJ2 were kept as SJ10585 and SJ10586, containing pSJ10585 and pSJ10586, respectively. The P27 containing fragment was excised from the vector prepared from SJ10561, ligated to pUC19, and correct transformants of *E. coli* SJ2 were kept as SJ10587 and SJ10588, containing pSJ10587 and pSJ10588, respectively.

Plasmid pVS2 was obtained in *Lactobacillus plantarum* NC8, a strain kept as SJ10491, extracted from this strain by standard plasmid preparation procedures known in the art, and transformed into *E. coli* MG1655 selecting erythromycin resistance (200 microgram/ml) on LB agar plates at 37° C. Two such transformants were kept as SJ10583 and SJ10584.

To insert P11 into pVS2, the P11-containing 176 bp HindIII fragment was excised and purified by agarose gel electrophoresis from pSJ10585, and ligated to HindIII-digested pVS2, which had been prepared from SJ10583. The ligation mixture was transformed by electroporation into *E. coli* MG1655, selecting erythromycin resistance (200 microgram/ml) on LB agar plates, and two transformants, which both harbor plasmids with the promoter insert in one particular of the two possible orientations, were kept as SJ10600 and SJ10601, containing pSJ10600 (FIG. 4) and pSJ10601.

pSJ10795

The 1152 bp coding sequence (without stop codon) of a thiolase gene identified in *Propionibacterium freudenreichii* was optimized for expression in the three organisms *Escherichia coli*, *Lactobacillus plantarum*, and *Lactobacillus reuteri* and synthetically constructed into pSJ10676. The DNA fragment containing the codon optimized CDS was designed with the sequence 5'-AAGCTTTC-3' immediately prior to the start codon (to add a HindIII site and convert the start region to a NcoI-compatible BspHI site), and the sequence 5'-TAGTCTAGACTCGAGGAATTCGGTACC-3' (SEQ ID NO: 459) immediately downstream (to add a stop codon, and restriction sites XbaI-XhoI-EcoRI-KpnI).

The resulting sequence was then submitted to and synthesized by Geneart AG (Regenburg, Germany) and delivered in the pMA backbone vector containing the β-lactamase encoding gene blaTEM-1. The DNA preparation delivered from Geneart was transformed into *E. coli* SJ2 by electroporation, selecting ampicillin resistance (200 microgram/ml) and two transformants kept, as SJ10676 (SJ2/pSJ10676) and SJ10677 (SJ2/pSJ10677).

The codon-optimized nucleotide sequence (CO), and deduced amino acid sequence of the *P. freudenreichii* thiolase gene are SEQ ID NOs: 460 and 461, respectively. The coding sequence is 1155 bp including the stop codon and the encoded predicted protein is 384 amino acids. Using the SignalP program (Nielsen et al., 1997, *Protein Engineering* 10: 1-6), no signal peptide in the sequence was predicted. Based on this program, the predicted mature protein contains 384 amino acids with a predicted molecular mass of 39.8 kDa and an isoelectric pH of 6.1.

Plasmid pSJ10676 was digested with BspHI and EcoRI, and the resulting 1.17 kb fragment purified using gel electrophoresis. Plasmid pSJ10600 was digested with NcoI and EcoRI, and the 5.2 kb fragment purified using gel electrophoresis. The purified fragments were mixed, ligated, and the ligation mixture transformed into TG1 electrocompetent cells, selecting erythromycin resistance (200 microgram/ml) on LB plates at 37° C. Four of the resulting colonies were analyzed and deemed to contain the desired recombinant plasmid by restriction analysis using NsiI, and one of these, further verified by DNA sequencing, was kept, resulting in SJ10795 (TG1/pSJ10795).

pSJ10798

The 1176 bp coding sequence (without stop codon) of a thiolase gene identified in *Clostridium acetobutylicum* was designed for optimized expression in the three organisms *Escherichia coli*, *Lactobacillus plantarum*, and *Lactobacillus reuteri* and synthetically constructed into pSJ10705. The DNA fragment containing the codon optimized coding sequence was designed with the sequence 5'-AAGCTTTC-3' immediately prior to the start codon (to add a HindIII site and convert the start region to a NcoI-compatible BspHI site), and the sequence 5'-TAGTCTAGACTCGAGGAAT-TCGGTACC-3' (SEQ ID NO: 459) immediately downstream (to add a stop codon, and restriction sites XbaI-XhoI-EcoRI-KpnI).

The resulting sequence was then submitted to and synthesized by Geneart AG (Regenburg, Germany) and delivered in the pMA backbone vector containing the β-lactamase encoding gene blaTEM-1. The DNA preparation delivered from Geneart was transformed into *E. coli* SJ2 by electroporation, selecting ampicillin resistance (200 microgram/ml) and two transformants kept, as SJ10705 (SJ2/pSJ10705) and SJ10706 (SJ2/pSJ10706).

The wild-type nucleotide sequence (WT), codon-optimized nucleotide sequence (CO), and deduced amino acid sequence of the *C. acetobutylicum* thiolase gene are SEQ ID NOs: 462, 463, and 464, respectively. The coding sequence is 1179 bp including the stop codon and the encoded predicted protein is 392 amino acids. Using the SignalP program (Nielsen et al. *Protein Engineering* 1997, 10, 1-6), no signal peptide in the sequence was predicted. Based on this program, the predicted mature protein contains 392 amino acids with a predicted molecular mass of 41.4 kDa and an isoelectric pH of 7.08.

Plasmid pSJ10705 was digested with BspHI and EcoRI, whereas pSJ10600 was digested with NcoI and EcoRI. The resulting 1193 bp fragment of pSJ10705 and the 5147 by fragment of pSJ10600 were each purified using gel electrophoresis and subsequently ligated as outlined herein.

An aliquot of the ligation mixture was used for transformation of *E. coli* TG1 by electroporation, and transformants selected on LB plates with 200 microgram/ml erythromycin. 3 of 4 colonies analyzed were deemed to contain the desired recombinant plasmid by restriction analysis using NsiI as well as DNA sequencing, and two of these were kept, resulting in SJ10798 (TG1/pSJ10798) and SJ10799 (TG1/pSJ10799).

pSJ10743

The 1167 bp coding sequence (without stop codon) of a thiolase gene identified in *Lactobacillus brevis* was optimized for expression in the three organisms *Escherichia coli*, *Lactobacillus plantarum*, and *Lactobacillus reuteri* and synthetically constructed into pSJ10699. The DNA fragment containing the codon optimized CDS was designed with the sequence 5'-AAGCTTCC-3' immediately prior to the start codon (to add a HindIII site and convert the start region to a NcoI site), and the sequence 5'-TAGTCTAGACTCGAG-GAATTCGGTACC-3' (SEQ ID NO: 459) immediately downstream (to add a stop codon, and restriction sites XbaI-XhoI-EcoRI-KpnI).

The resulting sequence was then submitted to and synthesized by Geneart AG (Regenburg, Germany) and delivered in the pMA backbone vector containing the β-lactamase encoding gene blaTEM-1. The DNA preparation delivered from Geneart was transformed into *E. coli* SJ2 by electroporation, selecting ampicillin resistance (200 microgram/ml) and two transformants kept, as SJ10699 (SJ2/pSJ10699) and SJ10700 (SJ2/pSJ10700).

The codon-optimized nucleotide sequence (CO), and deduced amino acid sequence of the *L. brevis* thiolase gene are SEQ ID NOs: 465 and 466, respectively. The coding sequence is 1170 bp including the stop codon and the encoded predicted protein is 389 amino acids. Using the SignalP program (Nielsen et al., 1997, supra), no signal peptide in the sequence was predicted. Based on this program, the predicted mature protein contains 389 amino acids with a predicted molecular mass of 40.4 kDa and an isoelectric pH of 6.5.

Plasmid pSJ10699 was digested with NcoI and EcoRI, and the resulting 1.18 kb fragment purified using gel electrophoresis. Plasmid pSJ10600 was digested with NcoI and EcoRI, and the 5.2 kb fragment purified using gel electrophoresis. The purified fragments were mixed, ligated, and the ligation mixture transformed into MG1655 electrocompetent cells, selecting erythromycin resistance (200 microgram/ml) on LB plates at 37° C. 16 of the resulting colonies were analyzed and two, deemed to contain the desired recombinant plasmid by restriction analysis using ClaI and further verified by DNA sequencing, were kept, resulting in SJ10743 (TG1/pSJ10743) and SJ10757 (TG1/pSJ10757).

pSJ10796

The 1176 bp thiolase coding sequence (without stop codon) from *Lactobacillus reuteri* was amplified from chromosomal DNA of SJ10468 (supra) using primers 671826 and 671827 shown below.

```
Primer 671826:
                                      (SEQ ID NO: 467)
5'-AGTCAAGCTTCCATGGAGAAGGTTTACATTGTTGC-3'

Primer 671827:
                                      (SEQ ID NO: 468)
5'-ATGCGGTACCGAATTCCTCGAGTCTAGACTAAATTTTCTTAAGCAG

AACCG-3'
```

The PCR reaction was programmed for 94° C. for 2 minutes; and then 19 cycles each at 95° C. for 30 seconds, 59° C. for 1 minute, and 72° C. for 2 minute; then one cycle at 72° C. for 5 minutes. A PCR amplified fragment of approximately 1.2 kb was digested with NcoI+EcoRI, purified by agarose gel electrophoresis, and then ligated to the agarose gel electrophoresis purified EcoRI-NcoI vector fragment of plasmid pSIP409 (WO2012/058603). The ligation mixture was transformed into *E. coli* SJ2, selecting ampicillin resistance (200 microgram/ml), and a transformant, deemed correct by restriction digest and DNA sequencing, was kept as SJ10694 (SJ2/pSJ10694).

The codon-optimized nucleotide sequence (CO), and deduced amino acid sequence of the *L. reuteri* thiolase gene are SEQ ID NOs: 469 and 470, respectively. The coding sequence is 1179 bp including the stop codon and the encoded predicted protein is 392 amino acids. Using the SignalP program (Nielsen et al., 1997, supra), no signal peptide in the sequence was predicted. Based on this program, the predicted mature protein contains 392 amino acids with a predicted molecular mass of 41.0 kDa and an isoelectric pH of 5.4.

Plasmid pSJ10694 was digested with NcoI and EcoRI, and the resulting 1.19 kb fragment purified using gel electrophoresis. Plasmid pSJ10600 was digested with NcoI and EcoRI, and the 5.2 kb fragment purified using gel electrophoresis. The purified fragments were mixed, ligated, and the ligation mixture transformed into TG1 electrocompetent cells, selecting erythromycin resistance (200 microgram/ml) on LB plates at 37° C. Four of the resulting colonies were analyzed and deemed to contain the desired recombinant plasmid by restriction analysis using NsiI, and two of these, further verified by DNA sequencing, were kept, resulting in SJ10796 (TG1/pSJ10796) and SJ10797 (TG1/pSJ10797).

pSJ10762

The 1068 bp CDS (without stop codon) of the isopropanol dehydrogenase (SWISSPROT:B2GDH6) from *L. fermentum* was optimized for expression in the three organisms *Escherichia coli*, *Lactobacillus plantarum*, and *Lactobacillus reuteri* and synthetically constructed into pSJ10703.

The DNA fragment containing the codon optimized isopropanol dehydrogenase CDS (sadh Lf) was designed with the sequence 5'-GGTAC CACTA TTACA AGGAG ATTTT AGTC-3' (SEQ ID NO: 471) immediately prior to the start codon (to add a KpnI site and a *Lactobacillus* RBS), and XmaI and HindIII restriction sites immediately downstream. The constructs were obtained from Geneart AG and transformed as previously described, resulting in SJ10703 (SJ2/pSJ10703) and SJ10704 (SJ2/pSJ10704).

The codon-optimized nucleotide sequence (CO) and deduced amino acid sequence of the *L. fermentum* isopropanol dehydrogenase gene is SEQ ID NO: 472 and 473, respectively. The coding sequence is 1071 bp including the stop codon and the encoded predicted protein is 356 amino acids. Using the SignalP program (Nielsen et al., 1997, supra), no signal peptide in the sequence was predicted. Based on this program, the predicted mature protein contains 356 amino acids with a predicted molecular mass of 37.9 kDa and an isoelectric pH of 5.2.

Figure 6:
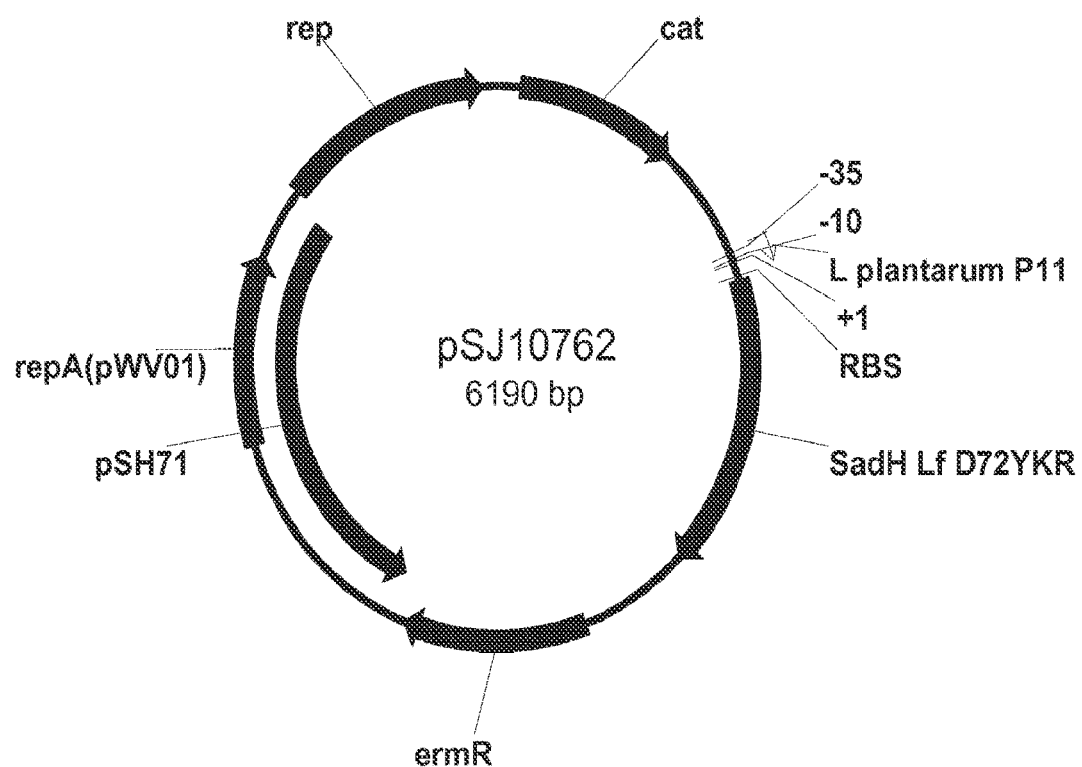
FIG. 6 shows a plasmid map for pSJ10762.

Plasmid pSJ10703 was digested with BspHI and XmaI, and the resulting 1.1 kb fragment purified using gel electrophoresis. Plasmid pSJ10600 was digested with XmaI and NcoI, and the resulting 5.1 kb fragment purified using gel electrophoresis. The purified fragments were mixed, ligated, and the ligation mixture transformed into JM103 as well as TG1 electrocompetent cells, selecting erythromycin resistance (200 microgram/ml) on LB plates at 37° C. Transformants were analyzed and two (one from each host strain), deemed to contain the desired recombinant plasmid by restriction analysis using ClaI and verified by DNA sequencing, were kept as SJ10762 (JM103/pSJ10762) and SJ10765 (TG1/pSJ10765). Transformant SJ10766 (JM103/pSJ10766) was also verified to contain the *Lactobacillus fermentum* isopropanol dehydrogenase gene. A plasmid map for pSJ10762 is shown in FIG. 6.

pSJ11298 (Temperature-Sensitive Vector)

A temperature-sensitive vector useful for integration into and subsequent excision from the *Lactobacillus* chromosome was based on pG+Host4 (Aggligene, France; see Biswas et al. *J. Bacteriol.* 1993, 175, 3628-3635). A plasmid replication origin functioning in *E. coli* was obtained by PCR amplification, using plasmid pUC19 (Yanisch-Perron et al. *Gene* 1985, 33, 103-119) as template, and primers 689229 and 689230 shown below.

```
Primer 689229:
                                      (SEQ ID NO: 474)
5'-GACTAAGCTTGGGCCCTCCTCGCTCACTGACTCGCT-3'

Primer 689230:
                                      (SEQ ID NO: 475)
5'-GACTGAATTCGGGCCCTCATGACCAAAATCCCTTAACG-3'
```

The approximately 0.8 kb DNA fragment obtained by the PCR amplification was digested with EcoRI+HindIII, and purified by agarose gel electrophoresis.

pG+Host4 was digested with EcoRI+HindIII, and the digested vector treated with alkaline phosphatase. Fragment and vector DNA was mixed, ligated, and the ligation mixture transformed into *E. coli* SJ2 competent cells, selecting erythromycin resistance (200 microgram/ml). A transformant, containing a plasmid with the pUC19 origin of replication inserted into the pG+Host4 backbone, was kept as SJ11298 (SJ2/pSJ11298).

Plasmid pSJ11298 was introduced into the SJ11294 mutant *Lactobacillus* strain (see Example 3) according to procedure B, described above, and a transformant obtained (SJ11487) was propagated at either 30° C. or 37° C. in MRS medium supplemented with erythromycin (10 microgram/ml). After overnight incubation, 400 µL of culture was inoculated into 1.5 mL MRS with 10 microgram/ml erythromycin. After growth for 3 hours at either 30° C. or 37° C., the cells were washed in 0.8 mL STE-buffer (containing, per liter, 26.8 ml 25% sucrose, 50 ml 1 M Tris (pH 7.5), and 2 ml 0.5 M EDTA), and plasmid DNA extracted using a Qiagen spin kit (Qiagen, Hilden, Germany).

Substantially more plasmid DNA was obtained from the 30° C. culture, as compared to the 37° C. culture, confirming the temperature-sensitive nature of the replication of this plasmid in *L. reuteri*.

pBKQ357

The plasmid vector pSIP409 (WO2012/058603) was used as template for PCR amplification of the reporter gene gusA coding for β-glucuronidase with a modified randomized primer pr029: 5'-CCCAT GTCGA CNNNN NNNNA GTTGT TGACA NNNNN NNNNN NNNNT GRTAW DNTNN NNNTA TAGCG TACTT AGCTG GCC-3' (SEQ ID NO: 516) described by Rud et al. (Rud et al. *Microbiology* 2006, 152, 1011-1019) and primer 665282: 5'-GCTAT CAATC AAAGC AAC-3'(SEQ ID NO: 517) using Phusion® Hot Start DNA polymerase (Finnzymes, Finland).

The PCR reaction was programmed for 94° C. for 2 minutes; and then 30 cycles each at 94° C. for 30 seconds, 56° C. for 1 minute, and 72° C. for 1 minute; then one cycle at 72° C. for 5 minutes. This resulted in a 2 kb fragment coding for a promoter and the gusA gene flanked by SalI and EcoRI restriction sites. The PCR product was purified using PCR Purification Kit (Qiagen, Hilden, Germany) as recommended by the manufacturer. The purified PCR product was then used to run an additional PCR cycle with primer 665282 as follows: 94° C. for 2:30 minutes, 56° C. for 1 minute, and 72° C. for 5 minutes. The PCR product (2 kb) was again purified using PCR Purification Kit (Qiagen, Hilden, Germany) as recommended by the manufacturer.

The PCR product was then digested with SalI+EcoRI, purified by agarose gel electrophoresis, and finally ligated to an agarose gel electrophoresis purified SalI-EcoRI vector fragment (3.1 kb) of plasmid pSIP411 (WO2012/058603). The ligation mixture was used to transform *E. coli* TG1, with selection for erythromycin resistance (200 microgram/ml).

An *E. coli* transformant containing plasmid pBKQ357 (5.1 kb) was identified to have following upstream sequence of the plasmid-encoded gusA gene: 5'-GTCGA CCCGG AAGTA GTTGT TGACA CGCAC CTGCT TGTGT GATAA ATTAA ATTTA TAGCG TACTT AGCTG GCC-3' (SEQ ID NO: 518).

Figure 9:
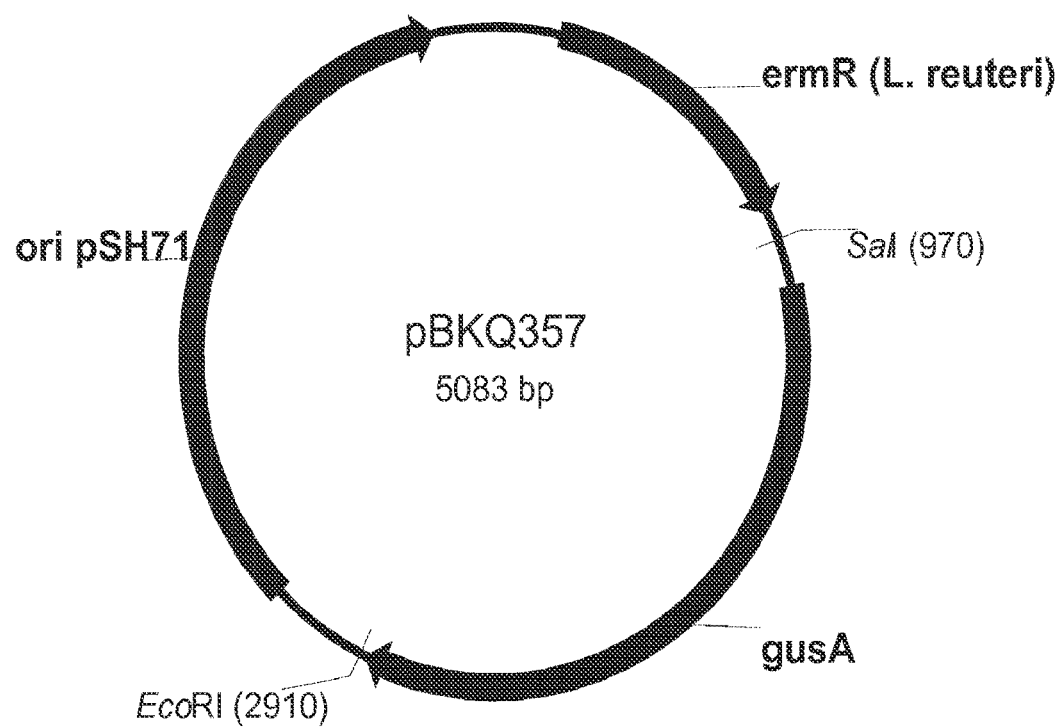
FIG. 9 shows a plasmid map for pBKQ357.

A plasmid map for the pBKQ357 is shown in FIG. 9.

pSJ11460

The plasmid pSJ11460 was chemically synthesized by Geneart AG (Regenburg, Germany) and contains a DNA sequence encoding an acetoacetate decarboxylase from *Lactobacillus plantarum*. The gene was obtained in a standard Geneart vector, which then was transformed into *E. coli* SJ2 electrocompetent cells, and a transformant kept as SJ11460 (the plasmid was denoted pSJ11460). The synthetic NcoI-KpnI fragment containing the acetoacetate decarboxylase gene (denoted adc_D13974) has the nucleotide sequence shown in SEQ ID NO: 515.

pSJ11464

The plasmid pSJ11464 was chemically synthesized by Geneart AG (Regenburg, Germany) and contains a DNA sequence encoding a secondary alcohol dehydrogenase from *Lactobacillus antri*. The gene was obtained in a standard Geneart vector, which then was transformed into *E. coli* SJ2 electrocompetent cells, and a transformant kept as SJ11464 (the plasmid was denoted pSJ11464). The synthetic KpnI-XmaI fragment containing the alcohol dehydrogenase gene (denoted sadh_D13976) has the nucleotide sequence shown in SEQ ID NO: 514.

pTRGU1065

The vector backbone of pBKQ357 was amplified by PCR using primers P540 and P541 below.

```
P540:
                                   (SEQ ID NO: 504)
5'-CAATGATCTAGACTCGAGGA-3'

P541:
                                   (SEQ ID NO: 505)
5'-GACGTACCATGGCTAAAATC-3'
```

For the PCR reaction was used Phusion® Hot Start DNA polymerase (Finnzymes, Finland) and the amplification reaction was programmed for 30 cycles at 98° C. for 2 minutes; 98° C. for 20 seconds, Gradient from 40° C. to 60° C. for 30 seconds, 72° C. for 1 minute 30 seconds; then one cycle at 72° C. for 5 minutes. All temperatures tested except 47.7° C. resulted in amplification of a 3.3 kb DNA fragment as estimated on agarose gel electrophoresis. The resulting PCR product was purified with a PCR Purification Kit (Qiagen, Hilden, Germany) according to manufacturer's instructions.

The PCR product above, pSJ10701 (WO2012/058603), and pSJ11464 (supra) were digested overnight at 37° C. with the restriction enzymes NcoI+XmaI, NcoI+KpnI, and KpnI+XmaI, respectively (New England Biolabs, Ipswich, Mass., USA). The restricted PCR product of pBKQ357 was dephosphorylated with 1 U Calf intestine phosphatase (CIP) (New England Biolabs) for 30 minutes at 37° C. All three digests were subsequently subject to electrophoresis on a 0.75% agarose gel, and bands having approximately 3.3 kb (pBKQ357 amplicon), 0.9 kb (adc_D72YKT), and 1.1 kb (sadh_D13976) were purified using a QIAquick Gel Extraction Kit (Qiagen) according to manufacturer's instructions.

Figure 7:
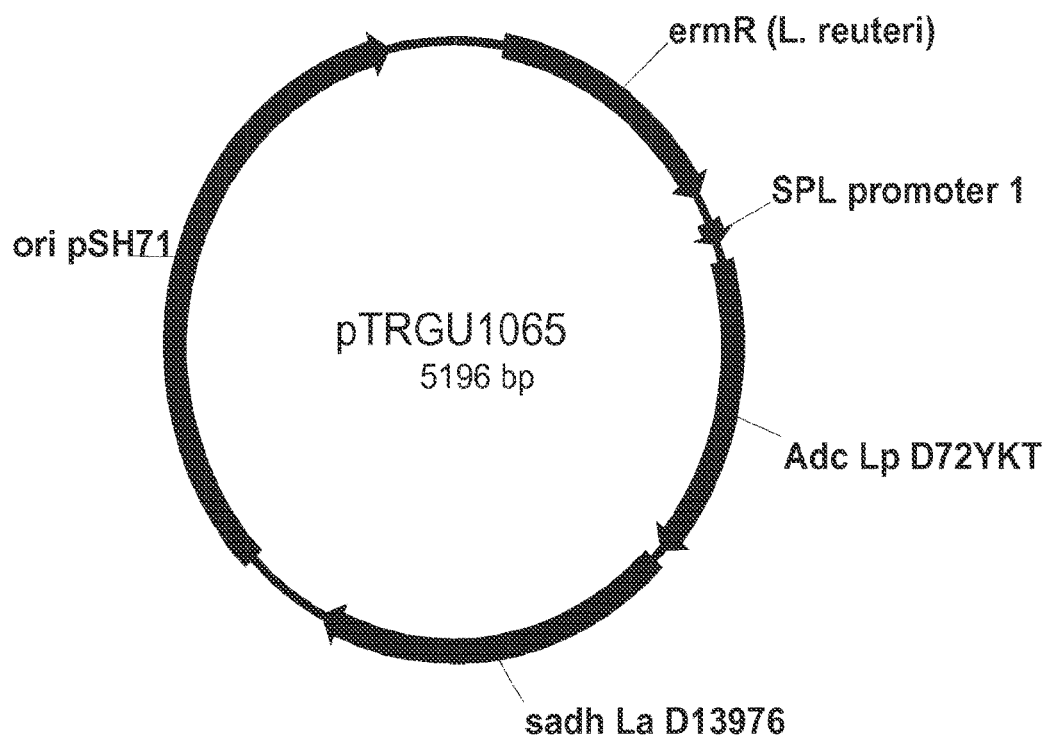
FIG. 7 shows a plasmid map for pTRGU1065.

The purified digested DNA fragments were ligated in a three-fragment ligation reaction overnight at room temperature using T4 DNA ligase in T4 DNA ligase buffer containing 10 mM ATP (F. Hoffmann-La Roche Ltd, Basel Switzerland). A 5 µL aliquot of the ligation mix was transformed into chemically competent *E. coli* TG1 via a 42° C. heat shock for 2 minutes. After 3 hours recovery with shaking at 37° C., the cells were plated onto LB agar plates containing 200 µg/ml erythromycin and incubated at 37° C. overnight. One colony, *E. coli* TRGU1065, was inoculated in liquid LB medium with 100 µg/mL erythromycin and incubated over night at 37° C. The corresponding plasmid pTRGU1065 was isolated using a Qiaprep® Spin Miniprep Kit (Qiagen) and subjected to DNA sequencing to confirm that adc_D72YKT and sadh_D13976 were cloned into the vector. *E. coli* TRGU1065 from the liquid overnight culture containing pTRGU44 was stored in 30% glycerol at −80° C. A plasmid map for pTRGU1065 is shown in FIG. 7.

pTRGU1073

Figure 8:
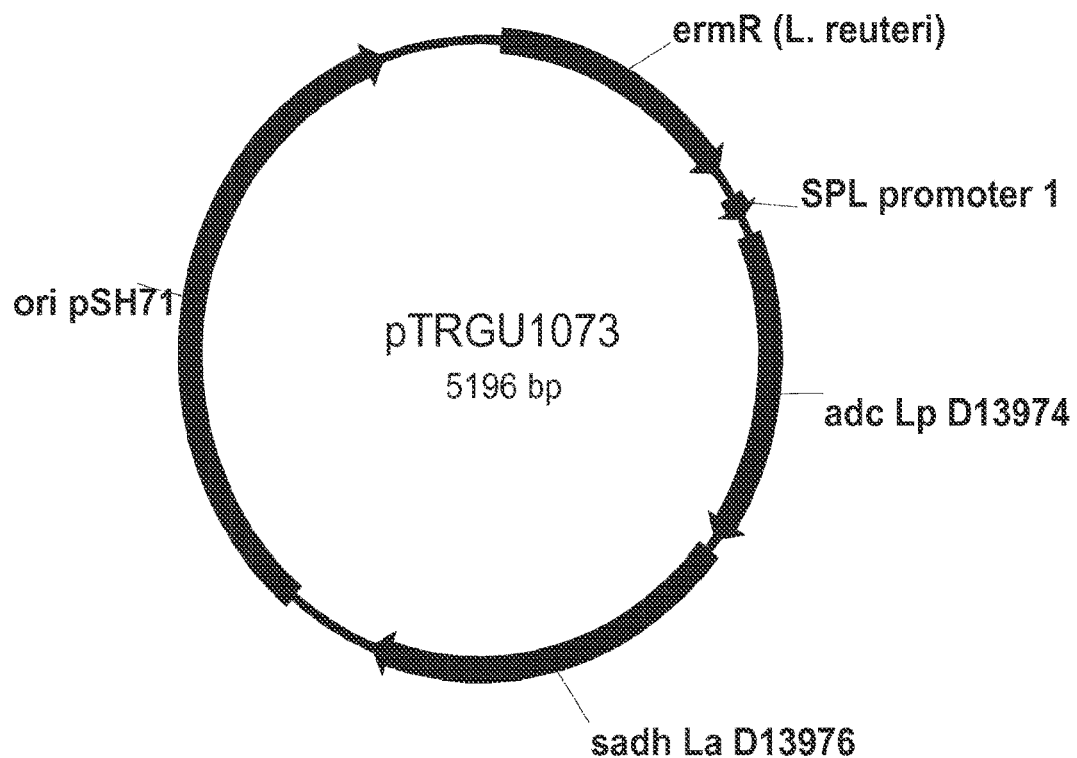
FIG. 8 shows a plasmid map for pTRGU1073.

The plasmid pTRGU1073 was constructed in essentially the same way as pTRGU1065 (supra), wherein adc_D72YKT was exchanged for adc_D13974. adc_D13974 was cloned from vector pSJ11460 (synthesized as described as follows). A plasmid map for pTRGU1073 is shown in FIG. 8.

Example 3: Isolation of a *Lactobacillus* Mutant with a Disrupted Gene Encoding a Specificity Subunit (LAR_0818) of a Type I Restriction Modification System The *Lactobacillus reuteri* mutant comprising a disrupted specificity subunit was initially generated and selected from the transformation experiment described below.

*L. reuteri* SJ10655 was transformed with plasmids pSJ10795, pSJ10796, pSJ10798, and pSJ10743 using the protocol described above (procedure A). Selection was conducted on MRS plates with 10 microgram/ml erythromycin, and on LCM plates (with 1% glucose) with 10 microgram/ml erythromycin. The plates were incubated anaerobically for 2 days at 37° C., whereafter colonies were counted. Results are shown in Table 1.

TABLE 1

| Transformed plasmid | No. colonies on MRS plates | No. colonies on LCM plates |
|---|---|---|
| pSJ10795 | ~200 | ~200 |
| pSJ10798 | 2 | 0 |
| pSJ10743 | ~200 | ~400 |
| pSJ10796 | ~500 | ~300 |

Two colonies from each of the MRS plates were inoculated into MRS medium with 10 microgram/ml erythromycin, and overnight cultures at 37° C. used for plasmid extraction. All plasmids were confirmed, based on a HindIII digest. The two transformants with pSJ10798 were kept as SJ11177 and SJ11178.

Strain SJ11177 was inoculated into MRS medium and incubated at 37° C. overnight. Aliquots were then used to inoculate MRS medium supplemented with novobiocin at a concentration of either 0.06 microgram/ml, 0.125 microgram/ml, or 0.25 microgram/ml, and cultures incubated at 30° C. for 5 days, without shaking. The strain had grown in all cultures, and a dilution series from the 0.25 microgram/ml novobiocin culture was plated on MRS to obtain single colonies, and plates incubated overnight at 37° C. Following incubation, plates were replicated onto MRS plates with and without 10 microgram/ml erythromycin, and these new plates incubated overnight at 37° C. Almost all colonies appeared erythromycin sensitive based on the replica. Four colonies were inoculated into 2 ml MRS medium, propagated for 4 hours at 37° C., and an aliquot used to inoculate 2 ml MRS medium cultures with 10 microgram/ml erythromycin, and all cultures incubated at 37° C. overnight. No growth was observed in the erythromycin-containing cultures.

Strains were frozen in the strain collection, from two of the MRS medium cultures, as SJ11294 and SJ11295. Strain SJ11294 was single colony purified three consecutive times, and the resulting isolate kept as SJ11400.

Example 4: Genomic Analysis of *Lactobacillus* Mutant Strain SJ11400 and Identification of the Disrupted Gene Encoding a Specificity Subunit (LAR_0818)

*Lactobacillus reuteri* mutant strain SJ11400 was sequenced using an Illumina Hi-Seq 2000 sequencer using sequencing kit TruSeq™ SBS v5 and HiSeq Control Soft. v. 1.4.8, RTA 1.12.4.2 and CASAVA 1.8.2 software (Illumina, San Diego, Calif., USA). A total number of 35,837,340 100 bp paired end reads (insert size 300 bp) were obtained. Since the optimal coverage for bacterial genomes was found to be around 400×, the read set was adjusted to 9,319,114 reads prior to the assembly. The reads were assembled with Idba v0.19 in to 1,909,167 bp in 155 contigs (Peng et al. *Research in Computational Molecular Biology* 2010, 6044, 426-440). The error rate was estimated with the maq software (Version 0.7.1) to 0.1 errors per 10 kb (maq.sourceforqe.net). The coverage of *Lactobacillus reuteri* mutant strain SJ11400 was calculated by parsing the result of the mapping with the Maq software. The coverage plot revealed that there were no large gaps in the mutant genome compared to the *Lactobacillus reuteri* JCM1112 genome.

A SNP analysis was conducted using CLC genomics workbench (www.cicbio.com; Version 4.8 with default settings). Due to the extremely high coverage, only 10% of the reads were used for the SNP analysis. The most significant SNPs in both the *Lactobacillus reuteri* mutant strain SJ11400 and the *Lactobacillus reuteri* parent strain SJ10655 are shown Table 2. Compared to the SNP analysis of the parent strain, a new SNP of the mutant strain is reported in the gene LAR_0818. A C-to-T substitution resulted in a stop codon mutation (Gln to stop) at position 162 in the protein sequence. A tfastx alignment of the wild-type protein and mutated protein is shown in FIG. 1. The LAR0818 protein is annotated in JCM1112 as a specificity subunit of a type I restriction modification system having SEQ ID NO: 2 which is encoded by the coding sequence of SEQ ID NO: 1.

TABLE 2

| Reference Position | Protein mutation | Gene | Annotation | Parent SJ10655 | Mutant SJ11400 |
|---|---|---|---|---|---|
| 562967 | Val23Gly | rpsD | Ribosomal protein | + | + |
| 932970 | Gln162* | LAR_0818 | Restriction specificity subunit | − | + |
| 946293 | Cys737Tyr | LAR_829 | Bacterial membrane protein | + | + |
| 1031437 | Met117Ile | LAR_0906 | hypothetical protein | + | + |
| 1873965 | Lys249* | LAR_1668 | hypothetical protein | + | + |

By reducing the variant frequency and coverage requirements for SNP calling, an expanded set of SNPs was obtained. The highest scoring SNPs were found in LAR1344 (Phe348Val, His342Gln) and LAR1346 (Val320Phe, Gln313His). Both LAR1344 and 1346 are annotated as a type 1 restriction medication proteins containing a specificity domain similar to LAR0818. The 3-prime end of the LAR1344 and LAR1346 region has a low coverage of paired end reads indicating that rearrangements could occur in the region. The mapping pattern appeared similar when reads from parent strain SJ10655 were mapped to JCM1112 indicating that parent strain SJ10655 and mutant strain SJ11400 are similar in this region but different from JCM1112. This was confirmed by mapping reads from mutant strain SJ11400 to the LAR1344-LAR1346 region in parent strain SJ10655. In this case there is a significant coverage of paired end reads and no SNPs are called confirming that SJ11400 and SJ10655 are identical in the region but different from JCM1112.

To further investigate the LAR1344-1346 region, the region from parent strain SJ10655 was aligned to the corresponding region in JCM1112 using mummer (mummersourceforge.net; Version 3.22). The corresponding alignment revealed that LAR1344 and LAR1346 have switched places in parent strain SJ10655 compared to JCM1112. The gene encoding LAR1345 situated between LAR1344 and LAR1346 is annotated as a site-specific tyrosine recombinase XerC in JCM1112. The LAR1344 and LAR1346 proteins in parent strain SJ10655 (which are identical to LAR1344 and LAR1346 proteins in the related strain SJ11400) are slightly changed in the C-terminus compared to the corresponding proteins in JCM1112 (FIGS. 2 and 3, respectively) and may be a result of the switching event. It has previously been described that restriction modification systems are linked to recombination-related genes such as integrases, invertases and transposases (Anton et al. *Gene* 1997, 187, 19-27; Brassard et al. *Gene* 1995, 157, 69-72) and in some cases are flanked by direct repeats (Lubys et al. *Nucleic Acids Res.* 1996, 24, 2760-2766; Gunn et al. Nucleic Acids Res. 1997, 25, 4147-4152). A direct repeat (5'-TCAC-CCTACAAACCTGAATTTG-3'; SEQ ID NO: 493) is found upstream of both LAR1344 and LAR1346 and another direct repeat (5'-TTTTGATTTGTCGACTTG-3'; SEQ ID NO: 494) at the end of the two genes.

Example 5: Improved Transformation Efficiency of *Lactobacillus* Mutants with a Disrupted Gene Encoding a Specificity Subunit (LAR_0818) of a Type I Restriction Modification System Initial transformation experiments were conducted using the SJ10655 parent *Lactobacillus* strain and the SJ11294 mutant *Lactobacillus* strain. SJ10655 and SJ11294 were each transformed with pSJ10798 or pSJ10762 according to the procedures described above (procedure B). The concentration of pSJ10762 was determined to 0.07 mg/ml, using a NanoDrop and analyzed in the software provided by the manufacturer (Thermo scientific, WA, USA). Concentrations of the other plasmids used in this example are expected to be at a similar level. Transformation of pSJ10762 and pSJ10798 into the SJ10655 parent strain resulted in 100 and 60 colonies, respectively. However, transformation using the SJ11294 mutant strain resulted in an almost overgrown plate for both pSJ10798 and pSJ10762. The SJ11294 mutant strain resulted in transformation at a 10-100 times higher frequency for pSJ10798 and pSJ10762 compared to the SJ10655 parent.

A subsequent transformation experiment was conducted using the SJ10655 parent *Lactobacillus* strain, the SJ11294 mutant *Lactobacillus* strain, and the single colony purified SJ11400 mutant *Lactobacillus* strain. Strains SJ10655, SJ11294, and SJ11400 were each transformed with pSJ10762 or the "empty" expression vector plasmid pSJ10600 according to the procedures described above (procedure B). The resulting number of colonies for each transformation is shown in Table 3.

TABLE 3

| Plasmid | SJ10655 | SJ11294 | SJ11400 |
|---|---|---|---|
| pSJ10600 | ~1000/50 μL | ~1000/50 μL | ~300/50 μL |
| pSJ10762 | 87/500 μL | ~1000/500 μL | ~500/500 μL |

The parent *Lactobacillus* strain SJ10655 transforms ~100 fold better with pSJ10600 as compared to pSJ10762. However, mutant *Lactobacillus* strains SJ11294 and SJ11400 improve the efficiency for pSJ10762 such that the difference is ~6-10 fold.

Example 6: Identification of Additional *Lactobacillus* Restriction Modification System Gene Targets Based on the improved transformation efficiency results described in Example 5, additional *Lactobacillus* restriction modification system targets for gene disruption to improved transformation efficiency were identified using the Restriction Enzyme Database (REBASE®; rebase.neb.com; Roberts et al. *Nucleic Acids Res.* 2010, 38, D234-D236). REBASE® search results for putative Type-I modification system targets in *Lactobacillus* are shown in Table 4.

TABLE 4

| | Enzyme ID | RM System | Subunit | Organism | Protein SEQ ID | Coding SEQ ID |
|---|---|---|---|---|---|---|
| 1 | LreF275ORF1347P | Type-I | restriction | *L. reuteri* F275 | 16 | 15 |
| 2 | LreF275ORF165P | Type-IV | — | *L. reuteri* F275 | 20 | 19 |
| 3 | LreF275ORF816P | Type-I | restriction | *L. reuteri* F275 | 8 | 7 |
| 4 | M.LreF275ORF1347P | Type-I | modification | *L. reuteri* F275 | 18 | 17 |
| 5 | M.LreF275ORF193P | Type-II | — | *L. reuteri* F275 | 22 | 21 |
| 6 | M.LreF275ORF816P | Type-I | modification | *L. reuteri* F275 | 10 | 9 |
| 7 | S1.LreF275ORF1347P | Type-I | specification | *L. reuteri* F275 | 14 | 13 |
| 8 | S1.LreF275ORF816P | Type-I | specification | *L. reuteri* F275 | 4 | 3 |
| 9 | S2.LreF275ORF1347P | Type-I | specification | *L. reuteri* F275 | 12 | 11 |
| 10 | S2.LreF275ORF816P | Type-I | specification | *L. reuteri* F275 | 6 | 5 |
| 11 | S3.LreF275ORF816P | Type-I | specification | *L. reuteri* F275 | 2 | 1 |
| 12 | Lac30ORF7870P | Type-I | restriction | *L. acidophilus* 30SC | 24 | 23 |
| 13 | Lac30ORF8410P | Type-I | restriction | *L. acidophilus* 30SC | 26 | 25 |
| 14 | Lam1118ORF7135P | Type-I | restriction | *L. amylovorus* GRL 1118 | 28 | 27 |
| 15 | Lam1118ORF9903P | Type-I | restriction | *L. amylovorus* GRL 1118 | 30 | 29 |
| 16 | LamGRLORF5415P | Type-I | restriction | *L. amylovorus* GRL 1112 | 32 | 31 |
| 17 | LamGRLORF8135P | Type-I | restriction | *L. amylovorus* GRL 1112 | 34 | 33 |
| 18 | Lca334ORF2094P | Type-I | restriction | *L. casei* | 36 | 35 |
| 19 | LcaBDORF2255P | Type-I | restriction | *L. casei* BD-II | 38 | 37 |
| 20 | LcaBDORF25P | Type-I | restriction | *L. casei* BD-II | 40 | 39 |
| 21 | LcaBLORF22740P | Type-I | restriction | *L. casei* BL | 42 | 41 |
| 22 | LcaLC2WORF17P | Type-I | restriction | *L. casei* LC2W | 44 | 43 |
| 23 | LcaLC2WORFAP | Type-I | restriction | *L. casei* LC2W | 46 | 45 |
| 24 | Lco3167ORFBP | Type-I | restriction | *L. coryniformis* subsp. coryniformis | 48 | 47 |
| 25 | Lco3167ORFCP | Type-I | restriction | *L. coryniformis* subsp. coryniformis | 50 | 49 |
| 26 | Lco3167ORFFP | Type-I | restriction | *L. coryniformis* subsp. coryniformis | 52 | 51 |

TABLE 4-continued

| | Enzyme ID | RM System | Subunit | Organism | Protein SEQ ID | Coding SEQ ID |
|---|---|---|---|---|---|---|
| 27 | Lco3167ORFGP | Type-I | restriction | L. coryniformis subsp. coryniformis | 54 | 53 |
| 28 | LcrORF1106P | Type-I | restriction | L. crispatus ST1 | 56 | 55 |
| 29 | Lcu705ORF320P | Type-I | restriction | L. curvatus CRL 705 | 58 | 57 |
| 30 | LcyORFAP | Type-I | restriction | L. acidipiscis KCTC 13900 | — | — |
| 31 | Lde1519ORF759P | Type-I | restriction | L. delbrueckii subsp. bulgaricus | 60 | 59 |
| 32 | Lde1632ORF56P | Type-I | restriction | L. delbrueckii subsp. bulgaricus | 62 | 61 |
| 33 | Lde1632ORF790P | Type-I | restriction | L. delbrueckii subsp. bulgaricus | 64 | 63 |
| 34 | Lde2038ORF895P | Type-I | restriction | L. delbrueckii subsp. bulgaricus 2038 | 66 | 65 |
| 35 | Lde204ORFAP | Type-I | restriction | L. delbrueckii subsp. lactis 204 | 68 | 67 |
| 36 | Lde82ORFAP | Type-I | restriction | L. delbrueckii subsp. lactis NCC82 | 70 | 69 |
| 37 | Lde88ORFAP | Type-I | restriction | L. delbrueckii subsp. lactis NCC88 | 72 | 71 |
| 38 | LdeAb1I | Type-I | restriction | L. delbrueckii subs. lactis Ab1 | — | — |
| 39 | LdeBBORF1050P | Type-I | restriction | L. delbrueckii subsp. bulgaricus ATCC BAA-365 | 74 | 73 |
| 40 | LdeBBORF958P | Type-I | restriction | L. delbrueckii subsp. bulgaricus ATCC BAA-365 | 76 | 75 |
| 41 | LdeBORF1052P | Type-I | restriction | L. delbrueckii subsp. bulgaricus | 78 | 77 |
| 42 | LdeNDORF377P | Type-I | restriction | L. delbrueckii subsp. bulgaricus ND02 | 80 | 79 |
| 43 | LdeNDORF970P | Type-I | restriction | L. delbrueckii subsp. bulgaricus ND02 | 82 | 81 |
| 44 | Lfa3681ORFAP | Type-I | restriction | L. farciminis | 84 | 83 |
| 45 | Lfe5716ORF672P | Type-I | restriction | L. fermentum CECT 5716 | 86 | 85 |
| 46 | LfeAORF1026P | Type-I | restriction | L. fermentum | 88 | 87 |
| 47 | LqaORF898P | Type-I | restriction | L. gasseri | 90 | 89 |
| 48 | Lhe5463ORFBP | Type-I | restriction | L. helveticus MTCC 5463 | 92 | 91 |
| 49 | LheDORF1154P | Type-I | restriction | L. helveticus DPC 4571 | 94 | 93 |
| 50 | LheDORF1480P | Type-I | restriction | L. helveticus DPC 4571 | 96 | 95 |
| 51 | LheORF662P | Type-I | restriction | L. helveticus H10 | 98 | 97 |
| 52 | Ljo33200ORF1214P | Type-I | restriction | L. johnsonii ATCC 33200 | 100 | 99 |
| 53 | LjoFORF1039P | Type-I | restriction | L. johnsonii FI9785 | 102 | 101 |
| 54 | Ljopf01ORF757P | Type-I | restriction | L. johnsonii pf01 | — | — |
| 55 | LkeZW3ORF1560P | Type-I | restriction | L. kefiranofaciens ZW3 | 104 | 103 |
| 56 | LplSTORF13P | Type-I | restriction | L. plantarum subsp. plantarum ST-III | 106 | 105 |
| 57 | LplWORF939P | Type-I | restriction | L. plantarum WCFS1 | 108 | 107 |
| 58 | Lre2112ORF20510P | Type-I | restriction | L. reuteri SD2112 | 110 | 109 |
| 59 | Lre53608ORF161P | Type-I | restriction | L. reuteri ATCC 53608 | 112 | 111 |
| 60 | LreFORF1436P | Type-I | restriction | L. reuteri DSM 20016 | 114 | 113 |
| 61 | LreFORF869P | Type-I | restriction | L. reuteri DSM 20016 | 116 | 115 |
| 62 | Lrh11ORF12315P | Type-I | restriction | L. rhamnosus R0011 | 118 | 117 |
| 63 | Lrh8530ORF2096P | Type-I | restriction | L. rhamnosus ATCC 8530 | — | — |
| 64 | LrhCASLORFCP | Type-I | restriction | L. rhamnosus CASL | 120 | 119 |
| 65 | LrhLcORF2091P | Type-I | restriction | L. rhamnosus Lc 705 | 122 | 121 |
| 66 | LrhLcORF36P | Type-I | restriction | L. rhamnosus Lc 705 | 124 | 123 |
| 67 | Lru211ORF446P | Type-I | restriction | L. ruminis SPM0211 | — | — |
| 68 | Lsa840ORF150P | Type-I | restriction | L. salivarius NIAS840 | 126 | 125 |
| 69 | Lsa840ORF1791P | Type-I | restriction | L. salivarius NIAS840 | 128 | 127 |
| 70 | Lsa840ORF332P | Type-I | restriction | L. salivarius NIAS840 | 130 | 129 |
| 71 | LsaGJ24ORF1047P | Type-I | restriction | L. salivarius GJ-24 | — | — |
| 72 | LsaGJ24ORF105P | Type-I | restriction | L. salivarius GJ-24 | — | — |
| 73 | LsaGJ24ORF1681P | Type-I | restriction | L. salivarius GJ-24 | — | — |
| 74 | LsaGJ24ORF656P | Type-I | restriction | L. salivarius GJ-24 | — | — |
| 75 | LsaORF761P | Type-I | restriction | L. salivarius CECT 5713 | 132 | 131 |
| 76 | LsapRV500ORFAP | Type-I | restriction | L. sakei | 134 | 133 |
| 77 | LsaSORF917P | Type-I | restriction | L. salivarius UCC118 | 136 | 135 |
| 78 | Lsu3549ORFAP | Type-I | restriction | L. suebicus KCTC 3549 | — | — |
| 79 | Lsu3549ORFEP | Type-I | restriction | L. suebicus KCTC 3549 | — | — |
| 80 | Lve3814ORFBP | Type-I | restriction | L. versmoldensis KCTC 3814 | — | — |
| 81 | Lze3804ORFCP | Type-I | restriction | L. zeae KCTC 3804 | | |
| 82 | M.Lac30ORF8410P | Type-I | modification | L. acidophilus 30SC | 138 | 137 |
| 83 | M.Lam1118ORF7135P | Type-I | modification | L. amylovorus GRL 1118 | 140 | 139 |
| 84 | M.LamGRLORF5415P | Type-I | modification | L. amylovorus GRL 1112 | 142 | 141 |
| 85 | M.LamGRLORF8135P | Type-I | modification | L. amylovorus GRL 1112 | 144 | 143 |
| 86 | M.Lca334ORF2094P | Type-I | modification | L. casei | 146 | 145 |
| 87 | M.LcaBDORF2255P | Type-I | modification | L. casei BD-II | 148 | 147 |

TABLE 4-continued

| Enzyme ID | RM System | Subunit | Organism | Protein SEQ ID | Coding SEQ ID |
|---|---|---|---|---|---|
| 88 M.LcaBDORF25P | Type-I | modification | L. casei BD-II | 150 | 149 |
| 89 M.LcaBLORF22740P | Type-I | modification | L. casei BL | 152 | 151 |
| 90 M.LcaLC2WORF17P | Type-I | modification | L. casei LC2W | 154 | 153 |
| 91 M.LcaLC2WORFAP | Type-I | modification | L. casei LC2W | 156 | 155 |
| 92 M.Lco3167ORFBP | Type-I | modification | L. coryniformis subsp. coryniformis | 158 | 157 |
| 93 M.Lco3167ORFCP | Type-I | modification | L. coryniformis subsp. coryniformis | 160 | 159 |
| 94 M.Lco3167ORFDP | Type-I | modification | L. coryniformis subsp. coryniformis | 162 | 161 |
| 95 M.Lco3167ORFEP | Type-I | modification | L. coryniformis subsp. coryniformis | 164 | 163 |
| 96 M.LcrORF1106P | Type-I | modification | L. crispatus ST1 | 166 | 165 |
| 97 M.Lcu705ORF320P | Type-I | modification | L. curvatus CRL 705 | 168 | 167 |
| 98 M.LcyORFBP | Type-I | modification | L. acidipiscis KCTC 13900 | — | — |
| 99 M.LcyORFHP | Type-I | modification | L. acidipiscis KCTC 13900 | — | — |
| 100 M.Lde1632ORF56P | Type-I | modification | L. delbrueckii subsp. bulgaricus | 170 | 169 |
| 101 M.Lde1632ORF790P | Type-I | modification | L. delbrueckii subsp. bulgaricus | 172 | 171 |
| 102 M.Lde204ORFAP | Type-I | modification | L. delbrueckii subsp. lactis 204 | 174 | 173 |
| 103 M.Lde82ORFAP | Type-I | modification | L. delbrueckii subsp. lactis NCC82 | 176 | 175 |
| 104 M.Lde88ORFAP | Type-I | modification | L. delbrueckii subsp. lactis NCC88 | 178 | 177 |
| 105 M.LdeBORF1052P | Type-I | modification | L. delbrueckii subsp. bulgaricus | 180 | 179 |
| 106 M.LdeNDORF377P | Type-I | modification | L. delbrueckii subsp. bulgaricus ND02 | 182 | 181 |
| 107 M.LdeNDORF970P | Type-I | modification | L. delbrueckii subsp. bulgaricus ND02 | 184 | 183 |
| 108 M.Lfa3681ORFAP | Type-I | modification | L. farciminis | 186 | 185 |
| 109 M.Lfe5716ORF672P | Type-I | modification | L. fermentum CECT 5716 | 188 | 187 |
| 110 M.LfeAORF1026P | Type-I | modification | L. fermentum | 190 | 189 |
| 111 M.LgaORF898P | Type-I | modification | L. gasseri | 192 | 191 |
| 112 M.Lhe5463ORFBP | Type-I | modification | L. helveticus MTCC 5463 | 194 | 193 |
| 113 M.LheDORF1154P | Type-I | modification | L. helveticus DPC 4571 | 196 | 195 |
| 114 M.LheDORF1480P | Type-I | modification | L. helveticus DPC 4571 | 198 | 197 |
| 115 M.LheORF662P | Type-I | modification | L. helveticus H10 | 200 | 199 |
| 116 M.Ljopf01ORF757P | Type-I | modification | L. johnsonii pf01 | — | — |
| 117 M.LkeZW3ORF313P | Type-I | modification | L. kefiranofaciens ZW3 | 202 | 201 |
| 118 M.LkeZW3ORF6P | Type-I | modification | L. kefiranofaciens ZW3 | 204 | 203 |
| 119 M.Lph48ORFAP | Type-I | modification | L. phage LBR48 | 206 | 205 |
| 120 M.LplSTORF13P | Type-I | modification | L. plantarum subsp. plantarum ST-III | 208 | 207 |
| 121 M.LplWORF939P | Type-I | modification | L. plantarum WCFS1 | 210 | 209 |
| 122 M.Lre2112ORF20510P | Type-I | modification | L. reuteri SD2112 | 212 | 211 |
| 123 M.Lre53608ORF161P | Type-I | modification | L. reuteri ATCC 53608 | 214 | 213 |
| 124 M.LreFORF1436P | Type-I | modification | L. reuteri DSM 20016 | 216 | 215 |
| 125 M.LreFORF869P | Type-I | modification | L. reuteri DSM 20016 | 218 | 217 |
| 126 M.Lrh11ORF12315P | Type-I | modification | L. rhamnosus R0011 | 220 | 219 |
| 127 M.Lrh8530ORF2096P | Type-I | modification | L. rhamnosus ATCC 8530 | — | — |
| 128 M.LrhCASLORFCP | Type-I | modification | L. rhamnosus CASL | 222 | 221 |
| 129 M.LrhLcORF2091P | Type-I | modification | L. rhamnosus Lc 705 | 224 | 223 |
| 130 M.LrhLcORF36P | Type-I | modification | L. rhamnosus Lc 705 | 226 | 225 |
| 131 M.Lru211ORF1967P | Type-I | modification | L. ruminis SPM0211 | — | — |
| 132 M.Lru211ORF446P | Type-I | modification | L. ruminis SPM0211 | — | — |
| 133 M.Lru211ORF889P | Type-I | modification | L. ruminis SPM0211 | — | — |
| 134 M.Lsa840ORF1870P | Type-I | modification | L. salivarius NIAS840 | 228 | 227 |
| 135 M.Lsa840ORF332P | Type-I | modification | L. salivarius NIAS840 | 230 | 229 |
| 136 M.LsaCORF1536P | Type-I | modification | L. salivarius CECT 5713 | 232 | 231 |
| 137 M.LsaGJ24ORF1047P | Type-I | modification | L. salivarius GJ-24 | — | — |
| 138 M.LsaGJ24ORF105P | Type-I | modification | L. salivarius GJ-24 | — | — |
| 139 M.LsaGJ24ORF1794P | Type-I | modification | L. salivarius GJ-24 | — | — |
| 140 M.LsaGJ24ORF656P | Type-I | modification | L. salivarius GJ-24 | — | — |
| 141 M.LsaORF761P | Type-I | modification | L. salivarius CECT 5713 | 234 | 233 |
| 142 M.LsapRV500ORFAP | Type-I | modification | L. sakei | 236 | 235 |
| 143 M.LsaSORF1758cP | Type-I | modification | L. salivarius UCC118 | 238 | 237 |
| 144 M.LsaSORF917P | Type-I | modification | L. salivarius UCC118 | 240 | 239 |
| 145 M.Lsu3549ORFAP | Type-I | modification | L. suebicus KCTC 3549 | — | — |
| 146 M.Lve3814ORFBP | Type-I | modification | L. versmoldensis KCTC 3814 | — | — |
| 147 M.Lze3804ORFCP | Type-I | modification | L. zeae KCTC 3804 | — | — |
| 148 M.Lze3804ORFEP | Type-I | modification | L. zeae KCTC 3804 | — | — |
| 149 M1.Lam1118ORF9903P | Type-I | modification | L. amylovorus GRL 1118 | 242 | 241 |

TABLE 4-continued

| Enzyme ID | RM System | Subunit | Organism | Protein SEQ ID | Coding SEQ ID |
|---|---|---|---|---|---|
| 150 M1.Lde2038ORF1048P | Type-I | modification | L. delbrueckii subsp. bulgaricus 2038 | 244 | 243 |
| 151 M1.LkeZW3ORF1560P | Type-I | modification | L. kefiranofaciens ZW3 | 246 | 245 |
| 152 M1.Lsa840ORF1791P | Type-I | modification | L. salivarius NIAS840 | 248 | 247 |
| 153 M1.LsaGJ24ORF1681P | Type-I | modification | L. salivarius GJ-24 | — | — |
| 154 M2.Lam1118ORF9903P | Type-I | modification | L. amylovorus GRL 1118 | 250 | 249 |
| 155 M2.Lde2038ORF1048P | Type-I | modification | L. delbrueckii subsp. bulgaricus 2038 | 252 | 251 |
| 156 M2.LkeZW3ORF1560P | Type-I | modification | L. kefiranofaciens ZW3 | 254 | 253 |
| 157 M2.Lsa840ORF1791P | Type-I | modification | L. salivarius NIAS840 | 256 | 255 |
| 158 M2.LsaGJ24ORF1681P | Type-I | modification | L. salivarius GJ-24 | — | — |
| 159 R1.Lde2038ORF1048P | Type-I | restriction | L. delbrueckii subsp. bulgaricus 2038 | 258 | 257 |
| 160 R1.LkeZW3ORF6P | Type-I | restriction | L. kefiranofaciens ZW3 | 260 | 259 |
| 161 R2.Lde2038ORF1048P | Type-I | restriction | L. delbrueckii subsp. bulgaricus 2038 | 262 | 261 |
| 162 S.Lac30ORF8410P | Type-I | specification | L. acidophilus 30SC | 264 | 263 |
| 163 S.Lam1118ORF9903P | Type-I | specification | L. amylovorus GRL 1118 | 266 | 265 |
| 164 S.Lbr367ORF24P | Type-I | specification | L. brevis | 268 | 267 |
| 165 S.LcaBDORF25P | Type-I | specification | L. casei BD-II | 270 | 269 |
| 166 S.LcaLC2WORF17P | Type-I | specification | L. casei LC2W | 272 | 271 |
| 167 S.Lco3167ORFBP | Type-I | specification | L. coryniformis subsp. coryniformis | 274 | 273 |
| 168 S.Lco3167ORFFP | Type-I | specification | L. coryniformis subsp. coryniformis | 276 | 275 |
| 169 S.LcyORFHP | Type-I | specification | L. acidipiscis KCTC 13900 | — | — |
| 170 S.Lde1632ORF56P | Type-I | specification | L. delbrueckii subsp. bulgaricus | 278 | 277 |
| 171 S.Lde1632ORF790P | Type-I | specification | L. delbrueckii subsp. bulgaricus | 280 | 279 |
| 172 S.LdelP | Type-I | specification | L. delbrueckii subsp. lactis | 282 | 281 |
| 173 S.LdeJBL2P | Type-I | specification | L. delbrueckii subsp. lactis pJBL2 | 284 | 283 |
| 174 S.LdeN42P | Type-I | specification | L. delbrueckii subsp. lactis pN42 | 286 | 285 |
| 175 S.LdeNDORF377P | Type-I | specification | L. delbrueckii subsp. bulgaricus ND02 | 288 | 287 |
| 176 S.LqaORF898P | Type-I | specification | L. gasseri | 290 | 289 |
| 177 S.Lhe5463ORF8548P | Type-I | specification | L. helveticus MTCC 5463 | 292 | 291 |
| 178 S.Lhe5463ORFBP | Type-I | specification | L. helveticus MTCC 5463 | 294 | 293 |
| 179 S.LheDORF1480P | Type-I | specification | L. helveticus DPC 4571 | 296 | 295 |
| 180 S.LheORF662P | Type-I | specification | L. helveticus H10 | 298 | 297 |
| 181 S.LjoFORFAP | Type-I | specification | L. johnsonii FI9785 | 300 | 299 |
| 182 S.LkeZW3ORF1560P | Type-I | specification | L. kefiranofaciens ZW3 | 302 | 301 |
| 183 S.Lma3596ORFGP | Type-I | specification | L. mali KCTC 3596 | — | — |
| 184 S.LpaCLWORF2P | Type-I | specification | L. paracasei CLW-011 | 304 | 303 |
| 185 S.LpelG1ORF114P | Type-I | specification | L. pentosus IG1 | 306 | 305 |
| 186 S.LplWORF939AP | Type-I | specification | L. plantarum WCFS1 | 308 | 307 |
| 187 S.LplWORF939BP | Type-I | specification | L. plantarum WCFS1 | 310 | 309 |
| 188 S.LplWORF939CP | Type-I | specification | L. plantarum WCFS1 | 312 | 311 |
| 189 S.Lre53608ORF161P | Type-I | specification | L. reuteri ATCC 53608 | 314 | 313 |
| 190 S.Lrh11ORF12315P | Type-I | specification | L. rhamnosus R0011 | 316 | 315 |
| 191 S.Lrh11ORF13772P | Type-I | specification | L. rhamnosus R0011 | 318 | 317 |
| 192 S.LrhLcORF2091AP | Type-I | specification | L. rhamnosus Lc 705 | 320 | 319 |
| 193 S.LrhLcORF2091BP | Type-I | specification | L. rhamnosus Lc 705 | 322 | 321 |
| 194 S.LrhLcORF36P | Type-I | specification | L. rhamnosus Lc 705 | 324 | 323 |
| 195 S.LrhLcORF838P | Type-I | specification | L. rhamnosus Lc 705 | 326 | 325 |
| 196 S.Lsa840ORF150P | Type-I | specification | L. salivarius NIAS840 | 328 | 327 |
| 197 S.Lsa840ORF1870P | Type-I | specification | L. salivarius NIAS840 | 330 | 329 |
| 198 S.Lsa840ORF332P | Type-I | specification | L. salivarius NIAS840 | 332 | 331 |
| 199 S.LsaGJ24ORF1872P | Type-I | specification | L. salivarius GJ-24 | — | — |
| 200 S.LsaGJ24ORF656P | Type-I | specification | L. salivarius GJ-24 | — | — |
| 201 S.LsaSORF915P | Type-I | specification | L. salivarius UCC118 | 334 | 333 |
| 202 S.LsaSORF916P | Type-I | specification | L. salivarius UCC118 | 336 | 335 |
| 203 S.LsaSORF917P | Type-I | specification | L. salivarius UCC118 | 338 | 337 |
| 204 S.Lsu3549ORFAP | Type-I | specification | L. suebicus KCTC 3549 | — | — |
| 205 S.Lsu3549ORFCP | Type-I | specification | L. suebicus KCTC 3549 | — | — |
| 206 S.Lze3804ORFCP | Type-I | specification | L. zeae KCTC 3804 | — | — |
| 207 S1.Lam1118ORF7135P | Type-I | specification | L. amylovorus GRL 1118 | 340 | 339 |
| 208 S1.LamGRLORF5415P | Type-I | specification | L. amylovorus GRL 1112 | 342 | 341 |
| 209 S1.LamGRLORF8135P | Type-I | specification | L. amylovorus GRL 1112 | 344 | 343 |
| 210 S1.Lca334ORF2094P | Type-I | specification | L. casei | 346 | 345 |
| 211 S1.LcaBDORF2255P | Type-I | specification | L. casei BD-II | 348 | 347 |
| 212 S1.LcaBLORF22740P | Type-I | specification | L. casei BL | 350 | 349 |
| 213 S1.LcaLC2WORFAP | Type-I | specification | L. casei LC2W | 352 | 351 |
| 214 S1.LcrORF1106P | Type-I | specification | L. crispatus ST1 | 354 | 353 |
| 215 S1.Lcu705ORF320P | Type-I | specification | L. curvatus CRL 705 | 356 | 355 |

TABLE 4-continued

| Enzyme ID | RM System | Subunit | Organism | Protein SEQ ID | Coding SEQ ID |
|---|---|---|---|---|---|
| 216 S1.LcyORFAP | Type-I | specification | L. acidipiscis KCTC 13900 | — | — |
| 217 S1.Lde2038ORF1048P | Type-I | specification | L. acidipiscis subsp. bulgaricus 2038 | 358 | 357 |
| 218 S1.Lde82ORFAP | Type-I | specification | L. delbrueckii subsp. lactis NCC82 | 360 | 359 |
| 219 S1.Lde88ORFAP | Type-I | specification | L. delbrueckii subsp. lactis NCC88 | 362 | 361 |
| 220 S1.LdeBORF1052P | Type-I | specification | L. delbrueckii subsp. bulgaricus | 364 | 363 |
| 221 S1.LdeNDORF970P | Type-I | specification | L. delbrueckii subsp. bulgaricus ND02 | 366 | 365 |
| 222 S1.Lfa3681ORFAP | Type-I | specification | L. farciminis | 368 | 367 |
| 223 S1.LheDORF1154P | Type-I | specification | L. helveticus DPC 4571 | 370 | 369 |
| 224 S1.Ljopf01ORF757P | Type-I | specification | L. johnsonii pf01 | — | — |
| 225 S1.LkeZW3ORF6P | Type-I | specification | L. kefiranofaciens ZW3 | 372 | 371 |
| 226 S1.LplSTORF13P | Type-I | specification | L. plantarum subsp. plantarum ST-III | 374 | 373 |
| 227 S1.Lre2112ORF20510P | Type-I | specification | L. reuteri SD2112 | 376 | 375 |
| 228 S1.LreFORF1436P | Type-I | specification | L. reuteri DSM 20016 | 378 | 377 |
| 229 S1.LreFORF869P | Type-I | specification | L. reuteri DSM 20016 | 380 | 379 |
| 230 S1.Lrh8530ORF2096P | Type-I | specification | L. rhamnosus ATCC 8530 | — | — |
| 231 S1.LrhCASLORFCP | Type-I | specification | L. rhamnosus CASL | 382 | 381 |
| 232 S1.Lru211ORF446P | Type-I | specification | L. ruminis SPM0211 | — | — |
| 233 S1.Lsa840ORF1791P | Type-I | specification | L. salivarius NIAS840 | 384 | 383 |
| 234 S1.LsaGJ24ORF1047P | Type-I | specification | L. salivarius GJ-24 | — | — |
| 235 S1.LsaGJ24ORF105P | Type-I | specification | L. salivarius GJ-24 | — | — |
| 236 S1.LsaGJ24ORF1681P | Type-I | specification | L. salivarius GJ-24 | — | — |
| 237 S1.LsaORF761P | Type-I | specification | L. salivarius CECT 5713 | 386 | 385 |
| 238 S1.LsapRV500ORFAP | Type-I | specification | L. sakei | 388 | 387 |
| 239 S1.Lve3814ORFBP | Type-I | specification | L. versmoldensis KCTC 3814 | — | — |
| 240 S2.Lam1118ORF7135P | Type-I | specification | L. amylovorus GRL 1118 | 390 | 389 |
| 241 S2.LamGRLORF5415P | Type-I | specification | L. amylovorus GRL 1112 | 392 | 391 |
| 242 S2.LamGRLORF8135P | Type-I | specification | L. amylovorus GRL 1112 | 394 | 393 |
| 243 S2.Lca334ORF2094P | Type-I | specification | L. casei | 396 | 395 |
| 244 S2.LcaBDORF2255P | Type-I | specification | L. casei BD-II | 398 | 397 |
| 245 S2.LcaBLORF22740P | Type-I | specification | L. casei BL | 400 | 399 |
| 246 S2.LcaLC2WORFAP | Type-I | specification | L. casei LC2W | 402 | 401 |
| 247 S2.LcrORF1106P | Type-I | specification | L. crispatus ST1 | 404 | 403 |
| 248 S2.Lcu705ORF320P | Type-I | specification | L. curvatus CRL 705 | 406 | 405 |
| 249 S2.LcyORFAP | Type-I | specification | L. acidipiscis KCTC 13900 | — | — |
| 250 S2.Lde2038ORF1048P | Type-I | specification | L. delbrueckii subsp. bulgaricus 2038 | 408 | 407 |
| 251 S2.Lde82ORFAP | Type-I | specification | L. delbrueckii subsp. lactis NCC82 | 410 | 409 |
| 252 S2.Lde88ORFAP | Type-I | specification | L. delbrueckii subsp. lactis NCC88 | 412 | 411 |
| 253 S2.LdeBORF1052P | Type-I | specification | L. delbrueckii subsp. bulgaricus | 414 | 413 |
| 254 S2.LdeNDORF970P | Type-I | specification | L. delbrueckii subsp. bulgaricus ND02 | 416 | 415 |
| 255 S2.Lfa3681ORFAP | Type-I | specification | L. farciminis | 418 | 417 |
| 256 S2.LheDORF1154P | Type-I | specification | L. helveticus DPC 4571 | 420 | 419 |
| 257 S2.Ljopf01ORF757P | Type-I | specification | L. johnsonii pf01 | — | — |
| 258 S2.LkeZW3ORF6P | Type-I | specification | L. kefiranofaciens ZW3 | 422 | 421 |
| 259 S2.LplSTORF13P | Type-I | specification | L. plantarum subsp. plantarum ST-III | 424 | 423 |
| 260 S2.Lre2112ORF20510P | Type-I | specification | L. reuteri SD2112 | 426 | 425 |
| 261 S2.LreFORF1436P | Type-I | specification | L. reuteri DSM 20016 | 428 | 427 |
| 262 S2.LreFORF869P | Type-I | specification | L. reuteri DSM 20016 | 430 | 429 |
| 263 S2.Lrh8530ORF2096P | Type-I | specification | L. rhamnosus ATCC 8530 | — | — |
| 264 S2.LrhCASLORFCP | Type-I | specification | L. rhamnosus CASL | 432 | 431 |
| 265 S2.Lru211ORF446P | Type-I | specification | L. ruminis SPM0211 | — | — |
| 266 S2.Lsa840ORF1791P | Type-I | specification | L. salivarius NIAS840 | — | — |
| 267 S2.LsaGJ24ORF1047P | Type-I | specification | L. salivarius GJ-24 | — | — |
| 268 S2.LsaGJ24ORF105P | Type-I | specification | L. salivarius GJ-24 | — | — |
| 269 S2.LsaGJ24ORF1681P | Type-I | specification | L. salivarius GJ-24 | — | — |
| 270 S2.LsaORF761P | Type-I | specification | L. salivarius CECT 5713 | 434 | 433 |
| 271 S2.LsapRV500ORFAP | Type-I | specification | L. sakei | 436 | 435 |
| 272 S2.Lve3814ORFBP | Type-I | specification | L. versmoldensis KCTC 3814 | — | — |
| 273 S3.LcyORFAP | Type-I | specification | L. acidipiscis KCTC 13900 | — | — |
| 274 S3.Lde2038ORF1048P | Type-I | specification | L. delbrueckii subsp. bulgaricus 2038 | 438 | 437 |
| 275 S3.Lde82ORFAP | Type-I | specification | L. delbrueckii subsp. 273 lactis NCC82 | 440 | 439 |
| 276 S3.LkeZW3ORF6P | Type-I | specification | L. kefiranofaciens ZW3 | 442 | 441 |

TABLE 4-continued

| Enzyme ID | RM System | Subunit | Organism | Protein SEQ ID | Coding SEQ ID |
|---|---|---|---|---|---|
| 277 S3.LplSTORF13P | Type-I | specification | L. plantarum subsp. plantarum ST-III | 444 | 443 |
| 278 S3.Lre2112ORF20510P | Type-I | specification | L. reuteri SD2112 | 446 | 445 |
| 279 S3.LreFORF869P | Type-I | specification | L. reuteri DSM 20016 | 448 | 447 |
| 280 S3.Lsa840ORF1791P | Type-I | specification | L. salivarius NIAS840 | 450 | 449 |
| 281 S3.LsaGJ24ORF1047P | Type-I | specification | L. salivarius GJ-24 | — | — |
| 282 S3.LsaGJ24ORF105P | Type-I | specification | L. salivarius GJ-24 | — | — |
| 283 S3.LsaGJ24ORF1681P | Type-I | specification | L. salivarius GJ-24 | — | — |
| 284 S3.LsaORF761P | Type-I | specification | L. salivarius CECT 5713 | 452 | 451 |
| 285 S4.Lde2038ORF1048P | Type-I | specification | L. delbrueckii subsp. bulgaricus 2038 | 454 | 453 |
| 286 S4.LplSTORF13P | Type-I | specification | L. plantarum subsp. plantarum ST-III | 456 | 455 |
| 287 S4.Lsa840ORF1791P | Type-I | specification | L. salivarius NIAS840 | 458 | 457 |
| 288 S4.LsaGJ24ORF1681P | Type-I | specification | L. salivarius GJ-24 | | |

Figure 5:
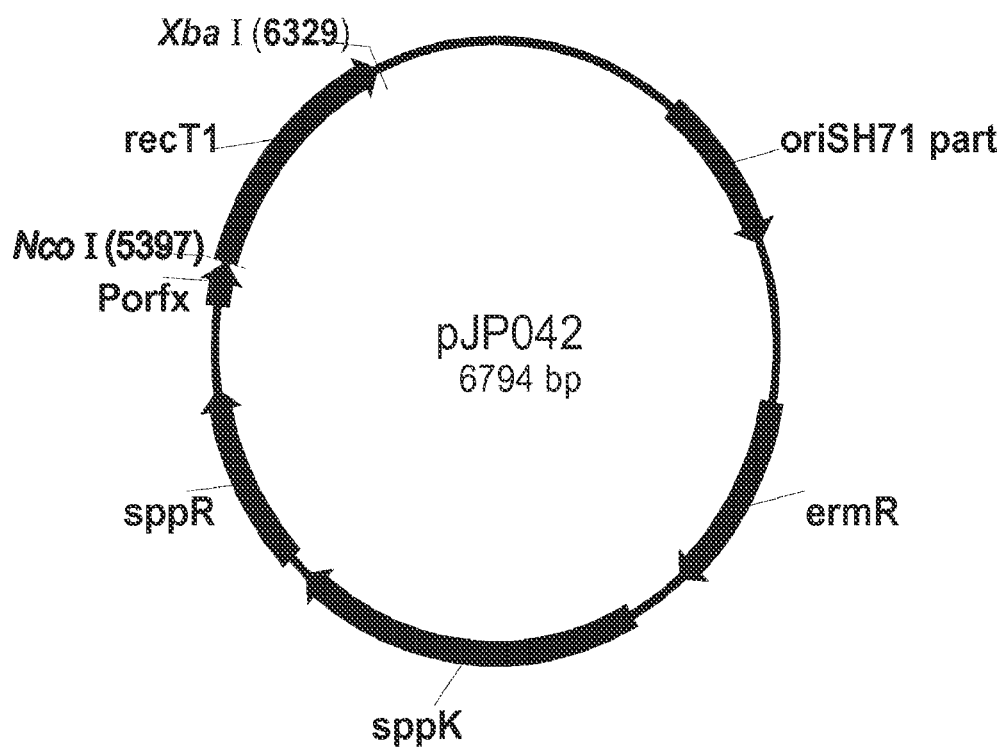
FIG. 5 shows a plasmid map for pJP042.

Example 7: Construction of a *Lactobacillus* Mutant with a Disrupted Gene Encoding a Restriction Subunit (LAR_0819) of a Type I Restriction Modification System MRS medium containing 5 µg/ml erythromycin was inoculated with a *L. reuteri* MM4 strain harboring pJP042 (Pijkeren and Britton *Nuc. Acids Res.* 2012, 1-13; FIG. 5) and incubated overnight at 37° C. The strain was subcultured in 10 ml MRS containing 5 µg/ml erythromycin to $OD_{600}$=0.1. The culture was incubated at 37° C. for approximately 4 hours to $OD_{600}$=0.8 and centrifuged at 8000×g for 5 minutes. The supernatant was discarded and the cells were resuspended in 10 ml SET buffer (0.1 M NaCl, 1 mM EDTA, 10 mM Tris-Cl). The suspension was centrifuged at 8000×g for 5 minutes and the supernatant was discarded. The cells were then resuspended in 1 ml lysis buffer (6.7% saccharose, 50 mM Tris-Cl pH 8, 0.1 mM EDTA). Lysozyme was added to 10 mg/ml and the mixture was incubated at 37° C. for 1 hour. The lysate was then centrifuged at 8000×g for 5 minutes. The plasmid pJP042 DNA was isolated from the supernatant using a PureYield™ MiniPrep kit (Promega, USA) following the directions of the manufacturer.

JCM1112 cells were made competent from an overnight culture in MRS containing 5 µg/ml erythromycin by subculturing in 40 ml MRS containing 5 µg/ml erythromycin to OD=0.1 and harvested at OD=0.8. The cells were kept on ice and washed carefully twice with 40 ml ice cold Wash Buffer (0.5M sucrose, 10% (VN) glycerol), and resuspended in 400 µl Wash Buffer.

5 µl of isolated pJP042 (supra) was added to 100 µl freshly prepared competent cells (supra) and electroporated in a BioRad Gene Pulser™ with a setting of 2.5 kV, 25 micro-Farad and 400 Ohms. To this was added 1 ml MRS medium and the cells incubated at 37° C. for 3 hours. The electroporated cells were incubated anaerobically overnight at 37° C. on MRS agar plates (MRS medium containing 15 g/l Bacto Agar) containing 5 µg/ml erythromycin for selection of pJP042 transformants. Erythromycin resistant colonies were checked for presence of pJP042 with colony PCR using primers flanking the recT1. Out of 11 transformants, 2 were isolated and confirmed to harbor pJP042. One of these strains was stored as TRGU768 in 10% glycerol at −80° C.

To disrupt the LAR_0819 gene by recombineering, four oligonucleotides below were designed using PyRec 3.1 (obtained from Robert Britton, Microbial Genomics Laboratory, Michigan State University, MI, USA).

o819:
(SEQ ID NO: 495)
5'-TCTATTTCTA CATTCGGACT AGTATAACTA GCACTTTTGT

AGAAAGCTTA GCCTACTTCA TCAAGACATC TTAAAGCAAT

GCCCTCTATA-3' o819_fwd:
(SEQ ID NO: 496)
5'-GAAATACTGATGATTCGTCCGATAGA-3' o819_mama:
(SEQ ID NO: 497)
5'-TAGTATAACTAGCACTTTTGTAGAAAGCT-3' o819_rev:
(SEQ ID NO: 498)
5'-TTATAAGTAGAAAATTGGGCAAAAGCTTGT-3'

The four oligonucleotides were designed to construct and screen for mutants with an in-frame stop codon and a HindIII restriction site. Sequence o819 was used for the recombineering and incorporation of the nucleotides AAGCT, which in the complementary direction implements a stop codon in the reading frame and thus results in disruption of gene translation. Oligonucleotides o819_fwd, o819_mama, and o819_rev were used in a PCR screen of all colonies screened. A 575 bp amplicon indicates that the mutations had been incorporated, whereas a single 1029 bp amplicon indicates that the o819_mama primer did not anneal due to the mismatch between oligo and the wild type sequence.

An overnight culture of TRGU768 was subcultured in 40 ml MRS medium containing 5 µg/ml erythromycin to $OD_{600}$ 0.1. After approximately 2 hours incubation at 37° C., $OD_{600}$ reached approximately 0.55 and recT1 expression was induced by addition of induction peptide (8 µl; 50 µg/ml) MAGNSSNFIHKIKQIFTHR (SEQ ID NO: 499). The incubation at 37° C. was prolonged for 20 minutes. Competent cells were then prepared by centrifugation and washing of the cells twice in 40 ml ice-cold Wash-Buffer (0.5M sucrose, 10% (v/v) glycerol). Finally the cells were resuspended in 800 ul Wash Buffer. 100 µl of the resuspended cells was used for each transformation. The cells were then transformed by electroporation with 5 µl o819 (20 µg/µl) as described in procedure A above. After 2 hours incubation in 1 ml MRS medium at 37° C., the cells were incubated anaerobically overnight on MRS agar plates.

96 individual colonies were analyzed by PCR using o819_fwd, o819_mama, and o819_rev. One colony resulted in two bands of correct sizes as estimated by agarose gel electrophoresis. Cultures were plated anaerobically on MRS agar plates overnight at 37° C. to obtain single colonies. Several colonies were tested with PCR using o819_fwd, o819_mama, and o819_rev resulting in two amplification products of correct sizes as estimated by agarose gel electrophoresis. One of these strains was stored as TRGU808 in 10% glycerol at −80° C. HindIII restriction digest of a PCR amplification product obtained with o819_fwd and o819_rev on TRGU808 resulted in complete digest of the 1029 bp product to a single band in the 575 bp region, confirming that the correct mutations had been incorporated for disruption of LAR_0819.

TRGU808 was tested for erythromycin sensitivity and was found to grow overnight in MRS medium containing 5 µg/ml erythromycin, confirming that it still harbored plasmid pJP042. Erythromycin sensitive colonies were isolated by first incubating the cells overnight in MRS medium without erythromycin, and subsequently plating onto MRS agar plates and incubated overnight at 37° C. The plates then were replicated onto MRS agar plates containing 5 µg/ml erythromycin. Several colonies were identified that were sensitive to erythromycin indicating that pJP042 had been lost. One such colony was stored as TRGU863 in 10% glycerol at −80° C.

Strain TRGU808 contains a disruption to the coding sequence of LAR_0819 (SEQ ID NO: 7) which encodes the restriction domain of a type I restriction modification system (SEQ ID NO: 8).

Example 8: Construction of a *Lactobacillus* Mutant with a Disrupted Gene Encoding a Type IV Methyl-Directed Restriction Enzyme (LAR_0165)

The gene encoding LAR_0165 was disrupted in a similar manner as described above for LAR_0819 using the four oligonucleotides below.

```
o165:
                                          (SEQ ID NO: 500)
5'-GACCACGTAA AGTTTTTACA TGACAGCAAT TCGTGCCGTA

ACGGAATTCA AATTGTCGAT GATTGGTTGT TGGTTAATAA

TTGCGGACCT-3' o165_fwd:
                                          (SEQ ID NO: 501)
5'-ATTTGTTGTGTGGACTATGTACGTTG-3' o165_mam:
                                          (SEQ ID NO: 502)
5'-GCAATTCGTGCCGTAACGGAATT-3' o165_rev:
                                          (SEQ ID NO: 503)
5'-TGGTTTTAATTTTTCCGGTTGCGTCA-3'
```

Strain TRGU768 (supra) was recombineered using oligo o165 as described above. Following overnight incubation at 37° C., 192 colonies were screened using oligonucleotides o165_fwd, o165_mama, and o165_rev. One colony was identified that resulted in two bands of correct sizes: 568 bp and 1047 bp. The mutant colony was grown overnight in MRS medium containing 5 µg/ml erythromycin and stored as TRGU802 in 10% glycerol at −80° C. 25 µl of the overnight culture was plated onto a MRS agar plate to obtain single colonies for isolation of a pure genotype of the mutant strain.

Eight individual colonies were reanalyzed by PCR using oligonucleotides o165_fwd, o165_mama, o165_rev. One colony, designated TRGU804, had a correct disruption mutant with a pure genotype and was stored in 10% glycerol at −80° C. HindIII restriction digest of the 1047 bp PCR amplification product verified the incorporation of the correct mutation.

TRGU804 was tested for erythromycin sensitivity and was found to grow overnight in MRS medium containing 5 µg/ml erythromycin, confirming that it still harbored plasmid pJP042. The mutant was cured for pJP042 as described above for the LAR_0819 mutant and the resulting strain was stored as TRGU867 in 10% glycerol at −80° C.

Strain TRGU867 contains a disruption to the coding sequence of LAR_0165 (SEQ ID NO: 19) which encodes the restriction domain of a type I restriction modification system (SEQ ID NO: 20).

Example 9: Construction of a *Lactobacillus* Mutant with a Disrupted Gene Encoding a Restriction Subunit (LAR_0819) of a Type I Restriction Modification System and a Disrupted Gene Encoding a Type IV Methyl-Directed Restriction Enzyme (LAR_0165)

TRGU804 (supra) was cultivated overnight in MRS medium containing 5 µg/ml erythromycin. Transformation with 5 µl of oligonucleotide o819 (20 µg/µl) following the procedure described in Example 7. Screening of 192 resulting colonies with oligonucleotides o819_fwd, o819_mama, and o819_rev provided five mutant strains containing two bands of correct sizes as described above. Pure genotypes were isolated after plating on MRS medium to obtain single colonies, reanalyzed by PCR, and checking for full digest of the 1029 bp PCR amplification product with HindIII. The HindIII digested amplicon showed that the colonies were pure genotypes and that the correct mutations had been incorporated. One strain did not grow overnight in MRS containing 5 µg/ml erythromycin indicating loss of plasmid pJP042. This strain was stored as TRGU872 in 10% glycerol at −80° C.

Strain TRGU872 contains a disruption to the coding sequence of LAR_0819 (SEQ ID NO: 7) which encodes the restriction domain of a type I restriction modification system (SEQ ID NO: 8); and a disruption to the coding sequence of LAR_0165 (SEQ ID NO: 19) which encodes the restriction domain of a type I restriction modification system (SEQ ID NO: 20).

Example 10: Improved Transformation Efficiency of *Lactobacillus* Mutants with a Disrupted Gene Encoding a Restriction Subunit (LAR_0819) of a Type I Restriction Modification System or a Disrupted Gene Encoding a Type IV Methyl-Directed Restriction Enzyme (LAR_0165)

In order to investigate the effect on transformation of disruptions to the *Lactobacillus* genes LAR_0165, LAR_0819, and combination of the two, the strains SJ10655, TRGU863, TRGU867 and TRGU872 described above were electroporated with 0.5 µg using between 0.4 µl and 3.3 µl plasmid DNA solution (measured on NanoDrop and analyzed in the software provided by the manufacturer; Thermo scientific, WA, USA). Electroporation was carried out using 1 mm electroporation cuvettes in a BioRad Gene Pulser™ with a setting of 1.2 kV; 25 microFarad; 400 Ohms.

Time constants obtained were all between 3.8 ms and 5.4 ms. 400 μl LCM medium containing 2% glucose was added and the cells were incubated without shaking for 4 hours at 37° C. before plating on MRS agar plates containing 5 μg/ml erythromycin. The results of counting the transformants are listed in Table 5.

TABLE 5

| Strain | pSJ10600 | pSJ10762 | pTRGU1065 | pTRGU1073 |
|---|---|---|---|---|
| SJ10655 | 1488 | 1 | 2 | 0 |
| TRGU863 | 270 | 0 | 20 | 1 |
| TRGU867 | 928 | 1 | 9 | 0 |
| TRGU872 | 614 | 4 | 502 | 95 |

The parent strain SJ10655 is readily transformed by the empty plasmid pSJ10600 but not by the other plasmids tested. Mutants TRGU863, TRGU867, and TRGU872 show certain differences observed with pSJ10600, minor effect with pSJ10762, but large differences for pTRGU1065 and pTRGU1073. The double mutant is readily transformed with both plasmids pTRGU1065 and pTRGU1073 whereas only one transformant is obtained for TRGU863 with pTGU1073 and between 9 and 20 for pTRGU1065. Thus, the disruption of restriction modification systems subunits LAR_0819 and LAR_0165 have a large effect on the transformation efficiencies of several of the plasmids tested.

Example 11: Disruption of the *Lactobacillus* Gene Encoding the Specificity Subunit LAR_0818 of a Type I Restriction Modification System Via Homologous Recombination Construction of LAR_0818 Disruption Vector pSJ11646 (And pSJ11670).

As a tool to disrupt the *L. reuteri* gene encoding the type I restriction modification system specificity subunit LAR_0818 (SEQ ID NO: 2) via homologous recombination, a pSJ11298-derived vector was constructed containing the LAR_0818 gene, from and including start to stop codon, with a small internal deletion containing a BamHI-site for insertion of other DNA. The coding sequence of the LAR_0818 gene with the internal deletion is shown in (SEQ ID NO: 488).

The two portions of the LAR_0818 gene were obtained by PCR amplification using chromosomal DNA from SJ10655 as template, and primers 697361+697362 for the upstream (5') portion, and primers 697363+697364 for the downstream (3') portion.

```
Primer 697361:
                                 (SEQ ID NO: 476)
5'-GACTGAATTCATGATTTATAAATACTTAGGAGATA-3'

Primer 697362:
                                 (SEQ ID NO: 477)
5'-GACTGGATCCTAAATTAGATACAACTTTATTTTGTAT-3'

Primer 697363:
                                 (SEQ ID NO: 478)
5'-GACTGGATCCTAGCTTTGAACAATCAAATAAATGA-3'

Primer 697364:
                                 (SEQ ID NO: 479)
5'-GACTCGGCCGTTAAAAATATTTCTTAAGCAAAGTCT-3'
```

The approximately 0.5 kb 5' fragment obtained using primers 697361+697362 was digested with EcoRI+BamHI, and purified by agarose gel electrophoresis. The approximately 0.63 kb 3' fragment obtained using primers 697363+697364 was digested with BamHI+EagI, and purified by agarose gel electrophoresis.

The cloning vector pSJ11298 was digested with EcoRI+EagI, treated with alkaline phosphatase, mixed with the purified 5'- and 3'-fragments of LAR_0818, ligated, and the ligation mixture transformed into *E. coli* SJ2 chemically competent cells, selecting erythromycin resistance (200 microgram/ml). A transformant, harbouring a plasmid deemed correct by restriction analysis and DNA sequencing, was kept as SJ11646 (SJ2/pSJ11646). Another similar transformant, obtained in the host strain *E. coli* TG1, was kept as SJ11670 (TG1/pSJ11670).

Construction of an Improved LAR_0818 Disruption Vector pSJ11700 (And pSJ11701).

To make a more versatile disruption/integration vector, a multiple cloning site was inserted into the BamHI site separating the LAR_0818 5' and 3' fragments.

The multiple cloning site was excised as a BamHI-BclI fragment of 75 bp from plasmid pDN3000 (Diderichsen et al. *J. Bacteriol.* 1990, 172, 4315-4321), prepared from a dam⁻ *E. coli* host strain, and purified by agarose gel electrophoresis. This fragment was ligated to BamHI-digested, alkaline phosphatase treated pSJ11646 DNA, purified by agarose gel electrophoresis, and the ligation mixture transformed into *E. coli* SJ2 by electroporation. Two transformants, deemed to contain correct plasmids by restriction analysis, were kept as SJ11700 (SJ2/pSJ11700) and SJ11701 (SJ2/pSJ11701).

Construction of pSJ11749, Containing LAR_0818 Segments Flanking an Antibiotic Resistance Cassette.

To insert a chloramphenicol resistance gene flanked by resolvase sites, the appropriate 1.2 kb fragment was prepared from pSJ3372 by digestion with BclI+BamHI and purified by agarose gel electrophoresis (prepared from a dam⁻ *E. coli* host; see WO 96/23073, FIG. 9 and examples). The fragment was mixed and ligated with a BamHI-digested, alkaline phosphatase treated and agarose gel purified pSJ11700 DNA fragment.

The ligation mixture was transformed into *E. coli* SJ2 by electroporation as described above, selecting both chloramphenicol resistance (10 microgram/ml) and erythromycin resistance (200 microgram/ml). A resulting transformant, containing a plasmid deemed correct by restriction analysis, was kept as SJ11749 (SJ2/pSJ11749).

Disruption of the *L. Reuteri* LAR_0818 Gene by an Antibiotic Resistance Cassette.

Plasmid pSJ11749 was transformed into *L. reuteri* strain SJ11400 by electroporation (procedure B), selecting erythromycin resistance (10 microgram/ml) on MRS agar plates incubated anaerobically at 30° C. Three transformants, containing the desired plasmid as confirmed by plasmid DNA extraction and digestion, were kept as SJ11902, SJ11903, and SJ11904 (all pSJ11749/SJ11400).

To isolate cells in which plasmid pSJ11749 had integrated into the chromosome, small scale (2 ml, eppendorf tubes) liquid cultures (MRS medium with 10 microgram/ml erythromycin) of strains SJ11902, -03, and -04 were propagated at 30° C. overnight. Aliquots from these cultures were spread on MRS agar plates with erythromycin (10 microgram/ml) which were incubated anaerobically at 45° C. overnight. As pSJ11749 is based on the thermosensitive pG+host4 replicon, colonies are only expected to form on the selective plates at 45° C. from cells which contain a chromosomally integrated plasmid (which means, that the erythromycin resistance gene would be replicated as part of the chromosome). Single colonies were obtained at 45° C., and were further reisolated at 45° C. Single colonies from the second reisolation at 45° C. were subsequently inoculated into liquid MRS cultures (without antibiotics) and incubated at 30° C. Incubation at the permissive temperature for pG+host4 replication allows initiation of plasmid replication from the integrated molecule, stimulating recombination, and eventually excision of the chromosomally integrated molecule and loss from the cell. If integration and excision took place by the same segment of homology, no change would have occurred, and the resulting cells would be sensitive to both erythromycin and chloramphenicol. If integration and excision took place by the two separate segments of homology, the antibiotic resistance cassette (with cat) would be left in the chromosome, and the resulting cells would be sensitive to erythromycin but resistant to chloramphenicol.

After overnight incubation at 30° C., aliquots from the MRS cultures were plated on MRS with chloramphenicol (6 microgram/ml), resulting colonies tested by replica plating onto MRS with chloramphenicol and erythromycin, respectively (6 and 10 microgram/ml), chloramphenicol resistant and erythromycin sensitive colonies reisolated and retested a few times, and eventually four strains, having the desired chloramphenicol resistant, erythromycin sensitive phenotype, were kept: SJ12025 and SJ12026, both derived from SJ11902, and SJ12027 and SJ12028, both derived from SJ11904.

These strains have the chromosomal LAR_0818 coding sequence disrupted by the cat antibiotic resistance cassette inserted centrally into the coding sequence; a small deletion centrally in LAR_0818 was introduced which removes the site of the mutation within LAR_0818, that was identified in strain SJ11400.

Example 12: Repair of the *Lactobacillus* Type I Restriction Modification System Specificity Subunit Gene LAR_0818 Disruption Construction of a LAR_0818 Repair Vector.

To be able to repair the LAR_0818 disruption, a temperature-sensitive vector was constructed which contained the entire wild type LAR_0818 coding region.

The LAR_0818 coding region (SEQ ID NO: 1) was contained on a PCR fragment obtained from SJ10655 chromosomal DNA, using the primers 697361+697364 (supra). The obtained 1.13 kb PCR fragment was digested with EcoRI+EagI, and purified by gel electrophoresis.

The temperature-sensitive vector pSJ11298 (supra) was digested with EcoRI+EagI, treated with alkaline phosphatase and purified by gel electrophoresis. The purified vector was ligated with the purified PCR fragment containing the LAR_0818 coding region, and the ligation mixture transformed into *E. coli* TG1 cells, selecting for erythromycin resistance (200 microgram/ml).

Two transformants, deemed to contain the desired plasmids by restriction analysis and DNA sequencing, were kept as SJ11668 (TG1/pSJ11668) and SJ11669 (TG1/pSJ11669).

Reversion of LAR_0818 Disruption Back to Wild Type.

Plasmids pSJ11668 and pSJ11669 were introduced into strains SJ12025 and SJ12027 by electroporation (procedure B), selecting erythromycin resistance (10 microgram/ml) on MRS agar plates incubated anaerobically at 30° C. Transformant colonies were plated on MRS agar with erythromycin, incubated anaerobically at 45° C. for two days, resulting colonies reisolated at 45° C. (two days), and colonies from these plates inoculated into liquid MRS cultures and incubated at 30° C. After overnight incubation, aliquots were spread on MRS agar plates as well as used to inoculate new liquid MRS cultures. Plates were incubated at 37° C., liquid cultures at 30° C. This procedure was repeated several consecutive times. Colonies appearing on plates were tested for antibiotic resistance phenotype by replica plating onto MRS agar, MRS agar with chloramphenicol (6 microgram/ml), and MRS agar with erythromycin (10 microgram/ml). Eventually, chloramphenicol sensitive and erythromycin sensitive strains were obtained from transformants of pSJ11669 into strain SJ12027. Two such strains were kept as SJ12099, and SJ12100.

To verify the reversion of the LAR_0818 disruption back to wildtype, LAR_0818 locus DNA was PCR amplified from strains SJ11400, SJ12099, and SJ12100 using primers 700148 and 700149, and the amplified DNA segments sequenced using the same primers as sequencing primers.

Primer 700148:
(SEQ ID NO: 508)
5'-GCGATGGTTAAACAACAAAATG-3'

Primer 700149:
(SEQ ID NO: 509)
5'-CCACAATAAATCACCTCTTTCTG-3'

The DNA sequencing confirms the mutation (to a stop codon) centrally within the LAR_0818 coding sequence in SJ11400, and confirms that the LAR_0818 coding sequence has been restored back to the wildtype sequence in strains SJ12099 and SJ12100.

Decreased Transformation Efficiency from Repair of the LAR_0818 Mutation Within SJ11400 Back to Wildtype Sequence.

To test the effect of repair of the LAR_0818 mutation on transformation efficiencies, strains SJ11400, SJ12099, and SJ12100 were rendered competent for transformation by electroporation and transformed (electroporation procedure B) with 40 nanogram of each of the following plasmids: pVS2 (prepared from SJ10655, i.e. the *L. reuteri* wildtype host strain), pSJ10600, pSJ10798, and pSJ10762 (the three latter prepared from *E. coli* host strains). Transformation mixtures were plated (each on two plates; 50 microliters and 450 microliters, respectively) on MRS agar plates with erythromycin (10 microgram/ml) and incubated anaerobically at 37° C. for two or 3 days before counting.

In two separate experiments, the total number of transformant colonies obtained are shown in Table 6 (top numbers from one experiment, bottom numbers from the separate experiment).

TABLE 6

|  | SJ11400 | SJ12099 | SJ12100 |
|---|---|---|---|
| pVS2 (from SJ10655) | 0 | 5 | 6 |
|  | 5 | 1 | 3 |
| pSJ10600 | 35 | 17 | 228 |
|  | 99 | 7 | 60 |
| pSJ10798 | 670 | 0 | 3 |
|  | 480 | 0 | 1 |
| pSJ10762 | 35 | 0 | 0 |
|  | 158 | 1 | 2 |

Example 13: Transformation Efficiency of *Lactobacillus* Mutants Having a Type I Restriction Modification System Specificity Subunit Gene LAR_0818 Disrupted Via Homologous Recombination To compare transformation into strains SJ12025 and SJ12027, both having the LAR_0818 coding sequence disrupted by the cat antibiotic resistance cassette inserted centrally into the coding sequence, to transformation into strains SJ12099 and SJ12100, containing the wildtype LAR_0818 sequence (derived from SJ12027 by reintroduction of a wildtype LAR_0818 sequence; supra), strains SJ12025, SJ12027, SJ12099, and SJ12100 were rendered competent for transformation by electroporation and transformed (electroporation procedure B) with 40 nanogram of each of the following plasmids: pVS2 (prepared from SJ10655, i.e. the *L. reuteri* wildtype host strain), pSJ10600, pSJ10798, and pSJ10762 (the three latter prepared from *E. coli* host strains). Transformation mixtures were plated (each on two plates; 50 microliters and 450 microliters, respectively) on MRS agar plates with erythromycin (10 microgram/ml) and incubated anaerobically at 37° C. for two or 3 days before counting.

In two separate experiments, the total number of transformant colonies obtained is shown in Table 7 (top numbers from one experiment, bottom numbers from the separate experiment).

TABLE 7

|  | SJ12025 Cat-insertion | SJ12027 Cat-insertion | SJ12099 Wildtype | SJ12100 Wildtype |
|---|---|---|---|---|
| pVS2 (from SJ10655) | 0 | 1 | 3 | 5 |
|  | 0 | 0 | 1 | 5 |
| pSJ10600 | 1 | 50 | 10 | Nd |
|  | 1 | 15 | 43 | 145 |
| pSJ10798 | 0 | 50 | 3 | 0 |
|  | 0 | 7 | 0 | 0 |
| pSJ10762 | 1 | 18 | 0 | 0 |
|  | 1 | 1 | 2 | 1 |

Nd: the transformation was not performed.

The experiments show that the strain SJ12027 with an insertion of a res-cat-res cassette into the LAR_0818 gene is transformed with plasmids pSJ10798 and pSJ10762 at approximately the same frequency as with pSJ10600, i.e. having no particular restriction barrier towards these plasmids as compared to pSJ10600, whereas the repaired strains SJ12099 and SJ12100 show a strongly decreased transformation frequency with plasmids pSJ10798 and pSJ10762, indicating the reintroduction of a restriction barrier for those plasmids in SJ12099 and SJ12100.

Example 14: Construction of Vectors for Disruption of *Lactobacillus* Genes Encoding the Type I Restriction Modification System Specificity Subunits LAR_1344 and LAR_1346 Via Homologous Recombination Construction of LAR_1344 Disruption Vector pSJ11679 (And pSJ11680).

As a tool to disrupt/delete the *L. reuteri* gene encoding the type I restriction modification system specificity subunit LAR_1344 (SEQ ID NO: 14) via homologous recombination, a pSJ11298-derived vector was constructed which contained a chromosomal fragment extending from upstream and just into the LAR_1344 coding sequence (5'_LAR_1344; SEQ ID NO: 489), followed by a chromosomal fragment extending from the end of the LAR_1344 coding sequence and downstream (3'_LAR_1344; SEQ ID NO: 490).

The two fragments were obtained by PCR amplification using chromosomal DNA from SJ10655 as template, and primers 697369+697370 for the 5' fragment, and primers 697371+697372 for the 3' fragment.

```
Primer 697369:
                                (SEQ ID NO: 480)
5'-GACTGAATTCCTTCAAGATAAGAAGAAA-3'

Primer 697370:
                                (SEQ ID NO: 481)
5'-GACTGGATCCGTAGTTAAATATTCATCTTTGG-3'

Primer 697371:
                                (SEQ ID NO: 482)
5'-GACTGGATCCAGCTTAATGCAAGAATATTTTGGG-3'

Primer 697372:
                                (SEQ ID NO: 483)
5'-GACTCGGCCGTCTGAACTTATGTGGATGAA-3'
```

The approximately 0.99 kb 5' fragment obtained using primers 697369+697370 was digested with EcoRI+BamHI, and purified by agarose gel electrophoresis. The approximately 1.0 kb 3' fragment obtained using primers 697371+697372 was digested with BamHI+EagI, and purified by agarose gel electrophoresis.

The cloning vector pSJ11298 was digested with EcoRI+EagI, treated with alkaline phosphatase, mixed with the purified 5'- and 3'-fragments of LAR_1344, ligated, and the ligation mixture transformed into *E. coli* SJ2 chemically competent cells, selecting erythromycin resistance (200 microgram/ml). Two transformants, harbouring a plasmid deemed correct by restriction analysis and DNA sequencing, were kept as SJ11679 (SJ2/pSJ11679) and SJ11680 (SJ2/pSJ11680).

Construction of an Improved LAR_1344 Disruption Vector pSJ11698 (and pSJ11699).

To make a more versatile disruption/integration vector, a multiple cloning site was inserted into the BamHI site separating the LAR_1344 5' and 3' fragments.

The multiple cloning site was excised as a BamHI-BclI fragment of 75 bp from plasmid pDN3000 (Diderichsen et al., *J. Bacteriol.* 1990, 172, 4315-4321), prepared from a dam⁻ *E. coli* host strain, and purified by agarose gel electrophoresis. This fragment was ligated to BamHI-digested, alkaline phosphatase treated pSJ11679 DNA, purified by agarose gel electrophoresis, and the ligation mixture transformed into *E. coli* SJ2 chemically competent cells. Two transformants, deemed to contain correct plasmids by restriction analysis, were kept as SJ11698 (SJ2/pSJ11698) and SJ11699 (SJ2/pSJ11699).

Insertion of Antibiotic Resistance Markers into LAR_1344 Disruption Vectors.

To further improve the disruption vectors, an antibiotic resistance marker was inserted next to the multiple cloning site between the 5' and 3' chromosomal fragments. The antibiotic resistance marker was further flanked by recognition sites (res) for the site-specific recombination enzyme (resolvase) from plasmid pAMβ1, thus allowing the eventual deletion of the marker by site-specific recombination mediated by the resolvase (see WO 96/23073).

To insert a chloramphenicol resistance gene flanked by resolvase sites, the appropriate 1.2 kb fragment was prepared from pSJ3372 by digestion with BclI-BamHI and purified by agarose gel electrophoresis (prepared from a dam⁻ *E. coli* host; see WO 96/23073, FIG. 9 and examples). The fragment was mixed and ligated with a BamHI-digested, alkaline phosphatase treated and agarose gel purified pSJ11698 DNA. The ligation mixture was transformed into *E. coli* SJ2 by electroporation as described above, selecting chloramphenicol resistance (10 microgram/ml), with colonies checked for both chloramphenicol and erythromycin resistance by replica plating. Two resulting transformants in which plasmids were deemed correct by restriction analysis and DNA sequencing, were kept as SJ11728 (SJ2/pSJ11728) and SJ11729 (SJ2/pSJ11729).

To insert a spectinomycin resistance gene flanked by resolvase sites, the appropriate 1.5 kb fragment was prepared from pSJ3358 by digestion with BclI-BamHI and purified by agarose gel electrophoresis (prepared from a dam⁻ E. coli host; see WO 96/23073, FIG. 18 and examples). The fragment was mixed and ligated with BamHI-digested, alkaline phosphatase treated and agarose gel purified pSJ11698 DNA. The ligation mixture was transformed into E. coli SJ2 chemically competent cells, selecting simultaneously for spectinomycin resistance (180 microgram/ml) and erythromycin resistance (200 microgram/ml). Two resulting transformants, in which plasmids were deemed correct by restriction analysis, were kept as SJ11739 (SJ2/pSJ11739) and SJ11740 (SJ2/pSJ11740).

Construction of LAR_1346 Disruption Vector pSJ11677 (And pSJ11678).

As a tool to disrupt/delete the L. reuteri gene encoding the type I restriction modification system specificity subunit LAR_1346 (SEQ ID NO: 12) via homologous recombination, a pSJ11298-derived vector was constructed which contained a chromosomal fragment extending from upstream and just into the LAR_1346 coding sequence (5'_LAR_1346; SEQ ID NO: 491), followed by a chromosomal fragment extending from the end of the LAR_1346 coding sequence and downstream (3'_LAR_1346; SEQ ID NO: 492).

The two fragments were obtained by PCR amplification using chromosomal DNA from SJ10655 as template, and primers 697365+697366 for the 5' fragment, and primers 697367+697368 for the 3' fragment.

```
Primer 697365:
                              (SEQ ID NO: 484)
5'-GACTGAATTCGGAAAATCAGTAATAAAGAATAC-3'

Primer 697366:
                              (SEQ ID NO: 485)
5'-GACTGGATCCATAAAGCCCACTGGACCAG-3'

Primer 697367:
                              (SEQ ID NO: 486)
5'-GACTGGATCCAAACTTTGTTCAACAAGTCGAC-3'

Primer 697368:
                              (SEQ ID NO: 487)
5'-GACTCGGCCGAGGGTATTGATTATCAATAATTCG-3'
```

The approximately 1.0 kb 5' fragment obtained using primers 697365+697366 was digested with EcoRI+BamHI, and purified by agarose gel electrophoresis. The approximately 1.0 kb 3' fragment obtained using primers 697367+697368 was digested with BamHI+EagI, and purified by agarose gel electrophoresis.

The cloning vector pSJ11298 was digested with EcoRI+EagI, treated with alkaline phosphatase, mixed with the purified 5'- and 3'-fragments of LAR_1346, ligated, and the ligation mixture transformed into E. coli SJ2 chemically competent cells, selecting erythromycin resistance (200 microgram/ml). Two transformants, harbouring a plasmid deemed correct by restriction analysis and DNA sequencing, were kept as SJ11677 (SJ2/pSJ11677) and SJ11678 (SJ2/pSJ11678).

Construction of an Improved LAR_1346 Disruption Vector PSJ11696 (And PSJ11697).

To make a more versatile disruption/integration vector, a multiple cloning site was inserted into the BamHI site separating the LAR_1346 5' and 3' fragments.

The multiple cloning site was excised as a BamHI-BclI fragment of 75 bp from plasmid pDN3000 (Diderichsen et al. J. Bacteriol. 1990, 172, 4315-4321), prepared from a dam⁻ E. coli host strain, and purified by agarose gel electrophoresis. This fragment was ligated to BamHI-digested, alkaline phosphatase treated pSJ11677 DNA, purified by agarose gel electrophoresis, and the ligation mixture transformed into E. coli SJ2 chemically competent cells. Two transformants, deemed to contain correct plasmids by restriction analysis, were kept as SJ11696 (SJ2/pSJ11696) and SJ11697 (SJ2/pSJ11697).

Insertion of Antibiotic Resistance Markers into LAR_1346 Disruption Vectors

To insert a chloramphenicol resistance gene flanked by resolvase sites, the appropriate 1.2 kb fragment was prepared from pSJ3372 by digestion with BclI-BamHI and purified by agarose gel electrophoresis (prepared from a dam⁻ E. coli host; see WO 96/23073, FIG. 9 and examples). The fragment was mixed and ligated with a BamHI-digested, alkaline phosphatase treated and agarose gel purified pSJ11696 DNA. The ligated mixture was transformed into pSJ11696 DNA. The ligated mixture was transformed into E. coli SJ2 by electroporation as described above, selecting chloramphenicol resistance (10 microgram/ml), with colonies checked for both chloramphenicol and erythromycin resistance by replica plating. Two resulting transformants in which plasmids were deemed correct by restriction analysis and DNA sequencing, were kept as SJ11726 (SJ2/pSJ11726) and SJ11727 (SJ2/pSJ11727).

To insert a spectinomycin resistance gene flanked by resolvase sites, the appropriate 1.5 kb fragment was prepared from pSJ3358 by digestion with BclI-BamHI and purified by agarose gel electrophoresis (prepared from a dam⁻ E. coli host; see WO 96/23073, FIG. 18 and examples). The fragment was mixed and ligated with BamHI-digested, alkaline phosphatase treated and agarose gel purified pSJ11696 DNA. The ligation mixture transformed into E. coli SJ2 chemically competent cells, selecting simultaneously spectinomycin resistance (180 microgram/ml) and erythromycin resistance (200 microgram/ml). Two resulting transformants, in which plasmids were deemed correct by restriction analysis, were kept as SJ11737 (SJ2/pSJ11737) and SJ11738 (SJ2/pSJ11738).

Construction of Vector for Simultaneous Disruption/Deletion of LAR_1344 and LAR_1346 (pSJ11741, pSJ11742)

As a tool to disrupt/delete both the L. reuteri gene encoding the type I restriction modification system specificity subunit LAR_1344 (SEQ ID NO: 14) and the L. reuteri gene encoding the type I restriction modification system specificity subunit LAR_1346 (SEQ ID NO: 12) via homologous recombination, a pSJ11298-derived vector was constructed which contained a chromosomal fragment extending from upstream and just into the LAR_1344 coding sequence (5'_LAR_1344; SEQ ID NO: 489), followed by a chromosomal fragment extending from the end of the LAR_1346 coding sequence and downstream (3'_LAR_1346; SEQ ID NO: 492).

Plasmids pSJ11679 and pSJ11677 were each digested with BamHI-KpnI. The resulting fragments (1.87 kb and 4.7 kb, respectively) were purified by agarose gel electrophoresis, ligated, and transformed into E. coli SJ2 by electroporation. Transformants were selected for erythromycin resistance (200 microgram/ml), and two transformants deemed to contain correct plasmids by restriction analysis were kept as SJ11741 (SJ2/pSJ11741) and SJ11742 (SJ2/pSJ11742).

Construction of an Improved LAR_1344-1346 Deletion Vector pSJ11755 (and pSJ11756).

To make a more versatile disruption/integration vector, a multiple cloning site was inserted into the BamHI site separating the LAR_1344-1346 fragments. The multiple cloning site was excised as a BamHI-BclI fragment of 75 bp from plasmid pDN3000 (Diderichsen et al. *J. Bacteriol.* 1990, 172, 4315-4321), prepared from a dam⁻ *E. coli* host strain SJ11671, and purified by agarose gel electrophoresis. This fragment was ligated to BamHI-digested, alkaline phosphatase treated pSJ11741 DNA, purified by agarose gel electrophoresis, and the ligation mixture transformed into *E. coli* SJ2 electrocompetent cells. Two transformants, deemed to contain correct plasmids by restriction analysis, were kept as SJ11755 (SJ2/pSJ11755) and SJ11756 (SJ2/pSJ11756).

Insertion of Antibiotic Resistance Markers into LAR_1344-1346 Deletion Vectors.

To insert a chloramphenicol resistance gene flanked by resolvase sites, the appropriate 1.2 kb fragment was prepared from pSJ3372 by digestion with BclI-BamHI and purified by agarose gel electrophoresis (prepared from a dam⁻ *E. coli* host; see WO 96/23073, FIG. 9 and examples). The fragment was mixed and ligated with a BamHI-digested, alkaline phosphatase treated and agarose gel purified pSJ11755 DNA. The ligation mixture was transformed into *E. coli* SJ2 by electroporation, selecting simultaneously chloramphenicol resistance (10 microgram/ml) and erythromycin resistance (200 microgram/ml). Three resulting transformants in which plasmids were deemed correct by restriction analysis were kept as SJ11799 (SJ2/pSJ11799), SJ11800 (SJ2/pSJ11800) and SJ11801 (SJ2/pSJ11801).

To insert a spectinomycin resistance gene flanked by resolvase sites, the appropriate 1.5 kb fragment was prepared from pSJ3358 by digestion with BclI-BamHI and purified by agarose gel electrophoresis (prepared from a dam⁻ *E. coli* host; see WO 96/23073, FIG. 18 and examples). The fragment was mixed and ligated with BamHI-digested, alkaline phosphatase treated and agarose gel purified pSJ11755 DNA. The ligation mixture transformed into *E. coli* SJ2 chemically competent cells, selecting simultaneously spectinomycin resistance (180 microgram/ml) and erythromycin resistance (200 microgram/ml). Two resulting transformants, in which plasmids were deemed correct by restriction analysis, were kept as SJ11794 (SJ2/pSJ11794) and SJ11795 (SJ2/pSJ11795).

Example 15: Construction of *Lactobacillus Reuteri* Strains Having the Specificity Subunits LAR_1344 or Both LAR_1344 and LAR_1346 of a Type I Restriction System Disrupted Via Homologous Recombination Construction of *Lactobacillus Reuteri* Host Strain SJ11774 (and SJ11775), Having LAR_1344 Disrupted (In Addition to LAR_0818).

Plasmid pSJ11729 (supra) was introduced into strain SJ11400 (supra) by electroporation using protocol B described above, selecting erythromycin resistance (10 microgram/ml) on MRS agar plates incubated anaerobically at 37° C. Two of the 11 transformants obtained were propagated in MRS medium with 10 microgram/ml erythromycin at 30° C. for 4 days, whereafter a 100 microliter aliquot was transferred to 1.8 ml MRS medium with 6 microgram/ml chloramphenicol, incubated at 45° C. overnight, and subsequently plated for single colonies on MRS with 6 microgram/ml chloramphenicol.

Two such colonies were inoculated into MRS medium and incubated overnight at 30° C., whereafter an aliquot was used to inoculate new MRS medium cultures that were again incubated overnight at 30° C. These cultures were subsequently plated for single colonies on MRS agar plates with 6 microgram/ml chloramphenicol, plates incubated overnight at 45° C., replica plated to MRS agar plates with either 6 microgram/ml chloramphenicol or 10 microgram/ml erythromycin, replica plates incubated overnight at 37° C., and erythromycin sensitive, chloramphenicol resistant strains isolated. PCR amplification confirmed absence of the ermR gene, and that the res-cat-res segment of plasmid pSJ11729 had been inserted into the *L. reuteri* SJ11400 chromosome, replacing the LAR_1344 gene originally present at that chromosomal location. Two such strains were kept as SJ11774 and SJ11775.

Construction of *Lactobacillus Reuteri* Host Strains SJ11841, SJ11842, and SJ11844, Having Both LAR_1344 and LAR_1346 Disrupted (In Addition to LAR_0818).

Each of plasmids pSJ11794 and pSJ11795 were introduced into strains SJ11774 and SJ11775 by electroporation using protocol B described above, selecting erythromycin resistance (10 microgram/ml) on MRS agar plates incubated anaerobically at 30° C. Transformants were taken through the plasmid integration/excision procedure essentially as previously described (isolation of erythromycin resistant colonies on 45° C. agar plates, propagation of these in liquid MRS without antibiotics at 30° C., plating to single colonies on MRS agar plates with spectinomycin (240 microgram/ml), replica plating to 3 sets of MRS agar plates with either spectinomycin (240 microgram/ml), chloramphenicol (6 microgram/ml), or erythromycin (10 microgram/ml), and isolation of spectinomycin resistant, erythromycin sensitive and chloramphenicol sensitive colonies. Three such strains were kept:

SJ11841, obtained from integration/excision of pSJ11794 in strain SJ11774.

SJ11842, obtained from integration/excision of pSJ11795 in strain SJ11774.

SJ11844, obtained from integration/excision of pSJ11795 in strain SJ11775.

Construction of *Lactobacillus Reuteri* Host Strains SJ11845 and SJ11890, Having Genes Belonging to Three Different Restriction Enzyme Systems Inactivated.

Plasmid pSJ11801, designed to partially delete both LAR_1344 and LAR_1346 and replace these with a cat gene, was introduced into strain TRGU872 (having already LAR_0165 and LAR_0819 disrupted) by electroporation using protocol B described above, selecting erythromycin resistance (10 microgram/ml) on MRS agar plates incubated anaerobically at 30° C. Four colonies were inoculated into 2 ml MRS cultures with erythromycin (10 microgram/ml) and chloramphenicol (6 microgram/ml) and incubated at 37° C. for 2 days. Cells had grown in two of these cultures, and these were plated to single colonies on MRS agar plates with erythromycin (10 microgram/ml), incubated at 45° C. for 2 days, single colonies inoculated into 2 ml MRS without antibiotics and incubated at 30° C. for 3 days, aliquots subsequently plated on MRS agar plates with chloramphenicol (6 microgram/ml) incubated at 37° C., and an erythromycin sensitive, chloramphenicol resistant strain identified by replica plating was kept as SJ11845.

The cat gene present in the chromosome of SJ11845 was subsequently removed by site-specific deletion using the resolvase from pAMbeta1. Plasmid pSJ3008 (AKA pWT) is a derivative of pAMbeta1 which carries the pAMbeta1 resolvase gene (described in WO 96/23073, FIG. 3 and example 6). This plasmid may be used to express the resolvase protein which can act on the two res sites (recognition sites for the resolvase) flanking the cat gene on the plasmid pSJ3372 (see WO 96/23073, FIG. 9 and examples), resulting in the site-specific deletion of the cat gene from the construct. When pSJ3372 was used in the construction of pSJ11801, fragments were used so that the cat gene inserted into pSJ11801 was flanked on either side with functional res sites. Consequently the cat gene, now present in the chromosome of SJ11845 in the LAR1344-LAR1346 locus, is flanked with functional res sites.

Strain SJ11845 was made electroporation competent, and transformed with plasmid pSJ3008, selecting erythromycin resistance (10 microgram/ml) at 30° C. Transformants were inoculated into liquid MRS medium without antibiotics and incubated at 30° C. Following growth, aliquots were plated to single colonies on MRS agar plates (37° C.), as well as reinoculated into liquid MRS medium, 30° C. This was repeated once. Replica plating was used to identify colonies that were erythromycin sensitive as well as chloramphenicol sensitive. One such strain, having the desired deletion of the cat gene confirmed by PCR amplification and DNA sequencing, was kept as SJ11890.

Example 16: Introduction of DNA into *Lactobacillus Reuteri* Strains Having the Specificity Subunits LAR_1344 or Both LAR_1344 and LAR_1346 of a Type I Restriction System Disrupted Via Homologous Recombination To test the effect of inactivation of LAR_1344 on transformation efficiencies, strains SJ10655, SJ11400, SJ11774, and SJ11775 were rendered competent for transformation by electroporation and transformed (electroporation procedure B) with 40 nanogram of each of the following plasmids: pVS2 (prepared from SJ10655, i.e. the *L. reuteri* wildtype host strain), pSJ3008 (a pAMbeta1 derivative, pWT, prepared from *B. subtilis*), pSJ10600, pSJ10798, pSJ10762, pTRGU1065, and pTRGU1073 (the five latter prepared from *E. coli* host strains). Transformation mixtures were plated (each on two plates; 50 microliters and 450 microliters, respectively) on MRS agar plates with erythromycin (10 microgram/ml) and incubated anaerobically at 37° C. for two or 3 days before counting. The obtained results are shown in Table 8.

TABLE 8

|  | SJ10655 Wild-type | SJ11400 LAR_0818 spontaneous mutant | SJ11774 LAR_0818 + LAR_1344::cat | SJ11775 LAR_0818 + LAR_1344::cat | SJ11841 | SJ11842 LAR_0818 + LAR_1344-46::spc | SJ11844 |
|---|---|---|---|---|---|---|---|
| pVS2 (from SJ10655) | 35 | 37 | 18 | 18 | 10 | 11 | 3 |
| pSJ10600 | 84 | 500 | 500 | 500 | 400 | 680 | 400 |
| pSJ3008 | 25 | 320 | 168 | 174 | 162 | 350 | 790 |
| pSJ10798 | 0 | 600 | 600 | 600 | 1530 | 1530 | 860 |
| pSJ10762 | 0 | 500 | 400 | 436 | 330 | 340 | 370 |
| pTRGU1065 | 0 | 0 | 0 | 1 | 1 | 3 | 1 |
| pTRGU1073 | 0 | 0 | 2 | 2 | 3 | 8 | 1 |

When normalized to pVS2 prepared from wildtype *L. reuteri* (count of colonies for pVS2 prepared from SJ10655 set to 100), the relative transformation efficiencies are obtained, as shown in Table 9.

TABLE 9

|  | SJ10655 Wild-type | SJ11400 LAR_0818 spontaneous mutant | SJ11774 LAR_0818 + LAR_1344::cat | SJ11775 LAR_0818 + LAR_1344::cat | SJ11841 | SJ11842 LAR_0818 + LAR_1344-46::spc | SJ11844 |
|---|---|---|---|---|---|---|---|
| pVS2 (from SJ10655) | 100 | 100 | 100 | 100 | 100 | 100 | 100 |
| pSJ10600 | 240 | 1351 | 2778 | 2778 | 4000 | 6182 | 13333 |
| pSJ3008 | 71 | 865 | 933 | 967 | 1620 | 3182 | 26333 |
| pSJ10798 | 0 | 1622 | 3333 | 3333 | 15300 | 13909 | 28666 |
| pSJ10762 | 0 | 1351 | 2222 | 2422 | 3300 | 3091 | 12333 |
| pTRGU1065 | 0 | 0 | 0 | 5 | 10 | 27 | 33 |
| pTRGU1073 | 0 | 0 | 11 | 11 | 30 | 73 | 33 |

These results indicate that the introduction of the LAR_1344 mutation, or introduction of the combined LAR_1344-LAR_1346 mutation, in addition to the LAR_0818 mutation already present in the SJ11400 host strain, may have a positive effect on transformation frequencies upon transformation with certain DNA molecules.

Example 17: Further Examples of Transformation of *L. Reuteri* Strains with Disruptions of Restriction System Genes Experiment 17.1

The plasmid preparations used in Example 16, above, were also used to transform batches of electroporation competent cells prepared from strains TRGU863, TRGU872, and SJ11845. These data are presented in Table 10 below, along with the data for strains SJ10655 and SJ11400 which have already been presented in Example 16, for comparison. The table contains data for two independent electroporations into TRGU867 and TRGU872.

ticularly increased transformability when the LAR_0819 and the LAR_0165 mutations are simultaneously present.

Experiment 17.2

For the following experiment, new preparations of plasmid DNA (except for pVS2, where the same batch (40 nanogram/microliter) as previously was used) were made, and new batches of electroporation competent *L. reuteri* strains were prepared. Results are shown in Table 11.

TABLE 10

Transformants pr. 40 nanogram plasmid DNA (electroporation as described in Example 16).

|  | SJ10655 Wild-type | SJ11400 LAR_0818 disruption from spontaneous mutant | TRGU863 LAR_0819 disruption | TRGU867 LAR_0165 disruption | TRGU872 LAR_0819 + LAR_0165 disruptions | SJ11845 LAR_0819 + LAR_0165 + LAR_1344-46::cat disruptions |
|---|---|---|---|---|---|---|
| pVS2 (from SJ10655) | 35 | 37 | 0 | 600 1710 | 500 920 | 1340 |
| pSJ10600 | 84 | 500 | 300 | 13 290 | 8 440 | 22 |
| pSJ3008 | 25 | 320 | 200 | 500 780 | 300 630 | 65 |
| pSJ10798 | 0 | 600 | 500 | 139 95 | 500 2540 | 1960 |
| pSJ10762 | 0 | 500 | 300 | 4 12 | 7 460 | 310 |
| pTRGU1065 | 0 | 0 | 0 | 1 3 | 93 76 | 183 |
| pTRGU1073 | 0 | 0 | 0 | 2 2 | 30 43 | 54 |

This experiment confirms that certain plasmids have increased transformability into strains containing either the LAR_0818 mutation, the LAR_0819 mutation, or the LAR_0165 mutation, and that certain plasmids have par-

TABLE 11

Transformants pr. 1 microliter plasmid DNA (electroporation as described in Example 16).

|  | Nanogram DNA used | SJ10655 Wild-type | SJ11400 LAR_0818 spontaneous mutant | SJ12099 LAR_0818 reverted | TRGU867 LAR_0165 | TRGU872 LAR_0819 + LAR_0165 disruptions | SJ11890 LAR_0819 + LAR_0165 + LAR_344-46 |
|---|---|---|---|---|---|---|---|
| pVS2 |  | 0 | 0 | 2 | 68 | 26 | 63 |
| pSJ10600 | 246 | 23 | 37 | 308 | 472 | 138 | 571 |
| pSJ3008 | 271 | 5 | 23 | 6 | 518 | 58 | 507 |

TABLE 11-continued

Transformants pr. 1 microliter plasmid DNA (electroporation as described in Example 16).

| | Nano-gram DNA used | SJ10655 Wild-type | SJ11400 LAR_0818 spontaneous mutant | SJ12099 LAR_0818 reverted | TRGU867 LAR_0165 | TRGU872 LAR_0819 + LAR_0165 disruptions | SJ11890 LAR_0819 + LAR_0165 + LAR_344-46 |
|---|---|---|---|---|---|---|---|
| pSJ10798 | 120 | 0 | 0 | 0 | 52 | 46 | 118 |
| pSJ10762 | 168 | 0 | 0 | 0 | 0 | 23 | 24 |
| pTRGU1065 | 100 | 0 | 0 | 0 | 0 | 50 | 120 |
| pTRGU1073 | 154 | 0 | 0 | 0 | 0 | 9 | 28 |

In this experiment the first two cell batches, SJ10655 and SJ11400, appear to give abnormally low number of transformants and may be very poor batches of electroporation competent cells, compared to what is generally obtained. The last four cell batches, SJ12099, TRGU867, TRGU872, and SJ11800, seem generally more competent (as seen from the pSJ10600 line), and the results here indicate a positive effect on transformation frequency of the LAR_0165 mutation as well as of the LAR_0819 mutation, and combinations containing these two mutations.

Experiment 17.3

For the following experiment, new batches of electroporation competent cells were prepared, whereas the plasmid DNA preparations used were the same as used in Experiment 18.2. Results are shown in Table 12.

TABLE 12

Transformants pr. 1 microliter plasmid DNA (electroporation as described in Example 16):

| | Nano-gram DNA used | SJ10655 Wild-type | SJ11400 LAR_0818 spontaneous mutant | SJ12099 LAR_0818 reverted | TRGU867 LAR_0165 | TRGU872 LAR_0819 + LAR_0165 disruptions | SJ11890 LAR_0819 + LAR_0165 + LAR_1344-46 |
|---|---|---|---|---|---|---|---|
| pVS2 | | 2 | 5 | 4 | 26 | 61 | 59 |
| pSJ10600 | 246 | 193 | 272 | 459 | 18 | 150 | 123 |
| pSJ3008 | 271 | 218 | 727 | 11 | 210 | 100 | 212 |
| pSJ10798 | 120 | 1 | 34 | 0 | 76 | 67 | 54 |
| pSJ10762 | 168 | 0 | 66 | 1 | 0 | 1 | 0 |
| pTRGU1065 | 100 | 0 | 3 | 1 | 1 | 94 | 97 |
| pTRGU1073 | 154 | 0 | 3 | 0 | 0 | 8 | 13 |

Thus for the indicated plasmids, TRGU867 (LAR_0165) and SJ11400 (LAR_0818) transform better than strains lacking the disruptions (SJ10655, SJ12099). Additionally, for indicated plasmids, TRGU872 (LAR_0165+LAR_0819) and SJ11890 (LAR_0165+LAR_0819+LAR_1344-LAR_1346) transform better than strains lacking the disruptions, and better than strains TRGU867 and SJ11400.

Example 18: Construction of Plasmids for Disruption of LAR_0165 by Homologous Recombination Construction of LAR_0165 Disruption Vector pSJ11897 (And pSJ11898).

As a tool to disrupt/delete the L. reuteri gene encoding the type IV restriction enzyme LAR_0165 (SEQ ID NO: 20) via homologous recombination, a pSJ11298-derived vector was constructed which contained a chromosomal fragment extending for 510 basepairs, starting appr. 100 basepairs into the LAR_0165 coding sequence of SEQ ID NO: 19, followed by a chromosomal fragment extending for 500 basepairs, ending appr. 70 basepairs from the end of the LAR_0165 coding sequence of SEQ ID NO: 19. These two fragments flank a 1.67 kb internal segment of the LAR_0165 coding sequence in the L. reuteri chromosome.

The two fragments were obtained by PCR amplification using chromosomal DNA from SJ10655 as template, and primers P5+P6 for the 5' fragment, and primers P7+P8 for the 3' fragment.

Primer P5:
(SEQ ID NO: 510)
5'-GACTGAATTCAATCATCGACAATTTGGCAA-3'

Primer P6:
(SEQ ID NO: 511)
5'-GAATGGATCCCGGGCTAGCTAATTTTTCCGGTTGCGTCA-3'

Primer P7:
(SEQ ID NO: 512)
5'-GCTAGCCCGGGATCCATTCGAGCAGGACTAGAAAGTGA-3'

Primer P8:
(SEQ ID NO: 513)
5'-GACTCTAGACGGCCGGCTTTTTTCTTTGGCCCAAC-3'

The two fragments of appr. 0.5 kb were obtained, mixed, and used as a template in a new (SOE) PCR reaction with primers P5 and P8. The expected fragment of appr. 1 kb was obtained, digested with EcoRI+EagI, and purified by agarose gel electrophoresis.

The cloning vector pSJ11698 was digested with EcoRI+EagI, treated with alkaline phosphatase, mixed with the purified 1 kb PCR fragment, ligated, and the ligation mixture transformed into E. coli TG1 electrocompetent cells, selecting erythromycin resistance (200 microgram/ml). Two transformants, harbouring a plasmid deemed correct by restriction analysis and DNA sequencing, were kept as SJ11897 (TG1/pSJ11897) and SJ11898 (TG1/pSJ11898).

Insertion of Antibiotic Resistance Markers into LAR_0165 Disruption Vectors.

To further improve the disruption vectors, an antibiotic resistance marker was inserted next to the cloning site between the 5' and 3' chromosomal fragments. The antibiotic resistance marker was further flanked by recognition sites (res) for the site-specific recombination enzyme (resolvase) from plasmid pAMBeta1, thus allowing the eventual deletion of the marker by site-specific recombination mediated by the resolvase (see WO 96/23073).

To insert a chloramphenicol resistance gene flanked by resolvase sites, the appropriate 1.2 kb fragment was prepared from pSJ3372 by digestion with BclI-BamHI and purified by agarose gel electrophoresis (prepared from a dam⁻ E. coli host; see WO 96/23073, FIG. 9 and examples). The fragment was mixed and ligated with a BamHI-digested, alkaline phosphatase treated and agarose gel purified pSJ11897 DNA. The ligation mixture was transformed into E. coli TG1 by electroporation, selecting chloramphenicol resistance (10 microgram/ml). Two resulting transformants in which plasmids were deemed correct by restriction analysis, were kept as SJ11926 (TG1/pSJ11926) and SJ11927 (TG1/pSJ11927).

To insert a spectinomycin resistance gene flanked by resolvase sites, the appropriate 1.5 kb fragment was prepared from pSJ3358 by digestion with BclI-BamHI and purified by agarose gel electrophoresis (prepared from a dam⁻ E. coli host; see WO 96/23073, FIG. 18 and examples). The fragment was mixed and ligated with BamHI-digested, alkaline phosphatase treated and agarose gel purified pSJ11897 DNA. The ligation mixture was transformed into E. coli TG1 electrocompetent cells, selecting simultaneously for spectinomycin resistance (180 microgram/ml) and erythromycin resistance (200 microgram/ml). Two resulting transformants, in which plasmids were deemed correct by restriction analysis, were kept as SJ11905 (TG1/pSJ11905) and SJ11906 (TG1/pSJ11906).

Although the foregoing has been described in some detail by way of illustration and example for the purposes of clarity of understanding, it is apparent to those skilled in the art that any equivalent aspect or modification may be practiced. Therefore, the description and examples should not be construed as limiting the scope of the invention.

The present invention may be further described by the following numbered paragraphs:

[1] An isolated mutant of a parent Lactobacillus strain, comprising a disruption to an endogenous gene encoding a type I restriction modification system subunit.

[2] The isolated mutant of paragraph [1], comprising a disruption to an endogenous gene encoding a restriction subunit of a type I restriction modification system or a disruption to an endogenous gene encoding a specificity subunit of a type I restriction modification system.

[3] The isolated mutant of paragraph [1], comprising a disruption to an endogenous gene encoding a restriction subunit of a type I restriction modification system.

[4] The isolated mutant of paragraph [1], comprising a disruption to an endogenous gene encoding a specificity subunit of a type I restriction modification system.

[5] The isolated mutant of paragraph [1], comprising a disruption to an endogenous gene encoding a restriction subunit of a type I restriction modification system and a disruption to an endogenous gene encoding a specificity subunit of a type I restriction modification system.

[6] The isolated mutant of any one of paragraphs [1]-[5], wherein (a) the restriction subunit has at least 60%, e.g., at least 70%, at least 75%, at least 80%, at least 85%, at least 90%, at least 95%, at least 97%, at least 98%, at least 99%, or 100% sequence identity to SEQ ID NO: 8, SEQ ID NO: 16, or the mature polypeptide sequence thereof; (b) the coding sequence of the gene encoding the restriction subunit hybridizes under at least low, medium, medium-high, high, or very high stringency conditions with the full-length complementary strand of SEQ ID NO: 7 or SEQ ID NO: 15; or (c) the coding sequence of the gene encoding the restriction subunit has at least 60%, e.g., at least 70%, at least 75%, at least 80%, at least 85%, at least 90%, at least 95%, at least 97%, at least 98%, at least 99%, or 100% sequence identity to SEQ ID NO: 7, SEQ ID NO: 15, or the mature polypeptide coding sequence thereof.

[7] The isolated mutant of any one of paragraphs [1]-[6], wherein the restriction subunit has at least 60%, e.g., at least 70%, at least 75%, at least 80%, at least 85%, at least 90%, at least 95%, at least 97%, at least 98%, at least 99%, or 100% sequence identity to SEQ ID NO: 8, SEQ ID NO: 16, or the mature polypeptide sequence thereof.

[8] The isolated mutant of any one of paragraphs [1]-[6], wherein the restriction subunit comprises or consists of SEQ ID NO: 8, SEQ ID NO: 16, or the mature polypeptide sequence thereof.

[9] The isolated mutant of any one of paragraphs [1]-[6], wherein the restriction subunit comprises or consists of SEQ ID NO: 8 or the mature polypeptide sequence thereof.

[10] The isolated mutant of any one of paragraphs [1]-[6], wherein the restriction subunit comprises or consists of SEQ ID NO: 8.

[11] The isolated mutant of any one of paragraphs [1]-[6], wherein the restriction subunit comprises or consists of the mature polypeptide sequence of SEQ ID NO: 8.

[12] The isolated mutant of any one of paragraphs [1]-[6], wherein the restriction subunit comprises or consists of SEQ ID NO: 16 or the mature polypeptide sequence thereof.

[13] The isolated mutant of any one of paragraphs [1]-[6], wherein the restriction subunit comprises or consists of SEQ ID NO: 16.

[14] The isolated mutant of any one of paragraphs [1]-[6], wherein the restriction subunit comprises or consists of the mature polypeptide sequence of SEQ ID NO: 16.

[15] The isolated mutant of any one of paragraphs [1]-[6], wherein the coding sequence of the gene encoding the restriction subunit hybridizes under at least low, medium, medium-high, high, or very high stringency conditions with the full-length complementary strand of SEQ ID NO: 7 or SEQ ID NO: 15.

[16] The isolated mutant of any one of paragraphs [1]-[6], wherein the coding sequence of the gene encoding the restriction subunit comprises a polynucleotide has at least 60%, e.g., at least 70%, at least 75%, at least 80%, at least 85%, at least 90%, at least 95%, at least 97%, at least 98%, at least 99%, or 100% sequence identity to SEQ ID NO: 7, SEQ ID NO: 15, or the mature polypeptide coding sequence thereof.

[17] The isolated mutant of any one of paragraphs [1]-[6], wherein the coding sequence of the gene encoding the restriction subunit comprises or consists of SEQ ID NO: 7, SEQ ID NO: 15, or the mature polypeptide coding sequence thereof.

[18] The isolated mutant of any one of paragraphs [1]-[6], wherein the coding sequence of the gene encoding the restriction subunit comprises or consists of SEQ ID NO: 7 or the mature polypeptide coding sequence thereof.

[19] The isolated mutant of any one of paragraphs [1]-[6], wherein the coding sequence of the gene encoding the restriction subunit comprises or consists of SEQ ID NO: 7.

[20] The isolated mutant of any one of paragraphs [1]-[6], wherein the coding sequence of the gene encoding the restriction subunit comprises or consists of the mature polypeptide coding sequence of SEQ ID NO: 7.

[21] The isolated mutant of any one of paragraphs [1]-[6], wherein the coding sequence of the gene encoding the restriction subunit comprises or consists of SEQ ID NO: 15, or the mature polypeptide coding sequence thereof.

[22] The isolated mutant of any one of paragraphs [1]-[6], wherein the coding sequence of the gene encoding the restriction subunit comprises or consists of SEQ ID NO: 15.

[23] The isolated mutant of any one of paragraphs [1]-[6], wherein the coding sequence of the gene encoding the restriction subunit comprises or consists of the mature polypeptide coding sequence of SEQ ID NO: 15.

[24] The isolated mutant of any one of paragraphs [1]-[23], wherein disruption occurs in the coding sequence of the gene encoding a restriction subunit.

[25] The isolated mutant of any one of paragraphs [1]-[23], wherein disruption occurs in a promoter sequence of the gene encoding a restriction subunit.

[26] The isolated mutant of any one of paragraphs [1]-[5] wherein (a) the specificity subunit has at least 60%, e.g., at least 70%, at least 75%, at least 80%, at least 85%, at least 90%, at least 95%, at least 97%, at least 98%, at least 99%, or 100% sequence identity to SEQ ID NO: 2, 4, 6, 12, 14, or the mature polypeptide sequence thereof; (b) the coding sequence of the gene encoding the specificity subunit hybridizes under at least low, medium, medium-high, high, or very high stringency conditions with the full-length complementary strand of SEQ ID NO: 1, 3, 5, 11, or 13; or (c) the coding sequence of the gene encoding the specificity subunit has at least 60%, e.g., at least 70%, at least 75%, at least 80%, at least 85%, at least 90%, at least 95%, at least 97%, at least 98%, at least 99%, or 100% sequence identity to SEQ ID NO: 1, 3, 5, 11, or 13, or the mature polypeptide coding sequence thereof.

[27] The isolated mutant of any one of paragraphs [1]-[26], wherein the specificity subunit has at least 60%, e.g., at least 70%, at least 75%, at least 80%, at least 85%, at least 90%, at least 95%, at least 97%, at least 98%, at least 99%, or 100% sequence identity to SEQ ID NO: 2, 4, 6, 12, 14, or the mature polypeptide sequence thereof.

[28] The isolated mutant of any one of paragraphs [1]-[5] or [26], wherein the specificity subunit comprises or consists of SEQ ID NO: 2, 4, 6, 12, 14, or the mature polypeptide sequence thereof.

[29] The isolated mutant of any one of paragraphs [1]-[26], wherein the specificity subunit comprises or consists of SEQ ID NO: 2, or the mature polypeptide sequence thereof.

[30] The isolated mutant of any one of paragraphs [1]-[26], wherein the specificity subunit comprises or consists of SEQ ID NO: 2.

[31] The isolated mutant of any one of paragraphs [1]-[26], wherein the specificity subunit comprises or consists of the mature polypeptide sequence of SEQ ID NO: 2.

[32] The isolated mutant of any one of paragraphs [1]-[26], wherein the specificity subunit comprises or consists of SEQ ID NO: 4, or the mature polypeptide sequence thereof.

[33] The isolated mutant of any one of paragraphs [1]-[26], wherein the specificity subunit comprises or consists of SEQ ID NO: 4.

[34] The isolated mutant of any one of paragraphs [1]-[26], wherein the specificity subunit comprises or consists of the mature polypeptide sequence of SEQ ID NO: 4.

[35] The isolated mutant of any one of paragraphs [1]-[26], wherein the specificity subunit comprises or consists of SEQ ID NO: 6, or the mature polypeptide sequence thereof.

[36] The isolated mutant of any one of paragraphs [1]-[26], wherein the specificity subunit comprises or consists of SEQ ID NO: 6.

[37] The isolated mutant of any one of paragraphs [1]-[26], wherein the specificity subunit comprises or consists of the mature polypeptide sequence of SEQ ID NO: 6.

[38] The isolated mutant of any one of paragraphs [1]-[26], wherein the specificity subunit comprises or consists of SEQ ID NO: 12, or the mature polypeptide sequence thereof.

[39] The isolated mutant of any one of paragraphs [1]-[26], wherein the specificity subunit comprises or consists of SEQ ID NO: 12.

[40] The isolated mutant of any one of paragraphs [1]-[26], wherein the specificity subunit comprises or consists of the mature polypeptide sequence of SEQ ID NO: 12.

[41] The isolated mutant of any one of paragraphs [1]-[26], wherein the specificity subunit comprises or consists of SEQ ID NO: 14, or the mature polypeptide sequence thereof.

[42] The isolated mutant of any one of paragraphs [1]-[26], wherein the specificity subunit comprises or consists of SEQ ID NO: 14.

[43] The isolated mutant of any one of paragraphs [1]-[26], wherein the specificity subunit comprises or consists of the mature polypeptide sequence of SEQ ID NO: 14.

[44] The isolated mutant of any one of paragraphs [1]-[26], wherein the coding sequence of the gene encoding the specificity subunit hybridizes under at least low, medium, medium-high, high, or very high stringency conditions with the full-length complementary strand of SEQ ID NO: 1, 3, 5, 11, or 13.

[45] The isolated mutant of any one of paragraphs [1]-[26], wherein the coding sequence of the gene encoding the specificity subunit comprises a polynucleotide has at least 60%, e.g., at least 70%, at least 75%, at least 80%, at least 85%, at least 90%, at least 95%, at least 97%, at least 98%, at least 99%, or 100% sequence identity to SEQ ID NO: 1, 3, 5, 11, 13, or the mature polypeptide coding sequence thereof.

[46] The isolated mutant of any one of paragraphs [1]-[26], wherein the coding sequence of the gene encoding the specificity subunit comprises or consists of SEQ ID NO: 1, 3, 5, 11, 13, or the mature polypeptide coding sequence thereof.

[47] The isolated mutant of any one of paragraphs [1]-[26], wherein the coding sequence of the gene encoding the specificity subunit comprises or consists of SEQ ID NO: 1, or the mature polypeptide coding sequence thereof.

[48] The isolated mutant of any one of paragraphs [1]-[26], wherein the coding sequence of the gene encoding the specificity subunit comprises or consists of SEQ ID NO: 1.

[49] The isolated mutant of any one of paragraphs [1]-[26], wherein the coding sequence of the gene encoding the specificity subunit comprises or consists of the mature polypeptide coding sequence of SEQ ID NO: 1.

[50] The isolated mutant of any one of paragraphs [1]-[26], wherein the coding sequence of the gene encoding the specificity subunit comprises or consists of SEQ ID NO: 3, or the mature polypeptide coding sequence thereof.

[51] The isolated mutant of any one of paragraphs [1]-[26], wherein the coding sequence of the gene encoding the specificity subunit comprises or consists of SEQ ID NO: 3.

[52] The isolated mutant of any one of paragraphs [1]-[26], wherein the coding sequence of the gene encoding the specificity subunit comprises or consists of the mature polypeptide coding sequence of SEQ ID NO: 3.

[53] The isolated mutant of any one of paragraphs [1]-[26], wherein the coding sequence of the gene encoding the specificity subunit comprises or consists of SEQ ID NO: 5, or the mature polypeptide coding sequence thereof.

[54] The isolated mutant of any one of paragraphs [1]-[26], wherein the coding sequence of the gene encoding the specificity subunit comprises or consists of SEQ ID NO: 5.

[55] The isolated mutant of any one of paragraphs [1]-[26], wherein the coding sequence of the gene encoding the specificity subunit comprises or consists of the mature polypeptide coding sequence of SEQ ID NO: 5.

[56] The isolated mutant of any one of paragraphs [1]-[26], wherein the coding sequence of the gene encoding the specificity subunit comprises or consists of SEQ ID NO: 11, or the mature polypeptide coding sequence thereof.

[57] The isolated mutant of any one of paragraphs [1]-[26], wherein the coding sequence of the gene encoding the specificity subunit comprises or consists of SEQ ID NO: 11.

[58] The isolated mutant of any one of paragraphs [1]-[26], wherein the coding sequence of the gene encoding the specificity subunit comprises or consists of the mature polypeptide coding sequence of SEQ ID NO: 11.

[59] The isolated mutant of any one of paragraphs [1]-[26], wherein the coding sequence of the gene encoding the specificity subunit comprises or consists of SEQ ID NO: 13, or the mature polypeptide coding sequence thereof.

[60] The isolated mutant of any one of paragraphs [1]-[26], wherein the coding sequence of the gene encoding the specificity subunit comprises or consists of SEQ ID NO: 13.

[61] The isolated mutant of any one of paragraphs [1]-[26], wherein the coding sequence of the gene encoding the specificity subunit comprises or consists of the mature polypeptide coding sequence of SEQ ID NO: 13.

[62] The isolated mutant of any one of paragraphs [1]-[61], wherein disruption occurs in the coding sequence of the gene encoding a specificity subunit.

[63] The isolated mutant of any one of paragraphs [1]-[61], wherein disruption occurs in a control sequence of the gene encoding a specificity subunit.

[64] The isolated mutant of any one of paragraphs [1]-[63], wherein the mutant produces at least 25% less (e.g., at least 50% less, at least 60% less, at least 70% less, at least 80% less, or at least 90% less) of the type I restriction modification system subunit encoded by the disrupted gene compared to the parent *Lactobacillus* strain when cultivated under identical conditions.

[65] The isolated mutant of any one of paragraphs [1]-[64], wherein the endogenous gene encoding the type I restriction modification system subunit is inactivated.

[66] The isolated mutant of any one of paragraphs [1]-[65], further comprising a disruption to an endogenous gene encoding a non-type I restriction modification system protein.

[67] The isolated mutant of any one of paragraphs [1]-[66], wherein the non-type I restriction modification system protein is a Type IV restriction modification system protein.

[68] The isolated mutant of any one of paragraphs [66] or [67], wherein (a) the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 20, SEQ ID NO: 22, or the mature polypeptide sequence thereof; (b) the coding sequence of the gene encoding the non-type I restriction modification system protein hybridizes under at least low, medium, medium-high, high, or very high stringency conditions with the full-length complementary strand of SEQ ID NO: 19 or SEQ ID NO: 21; or (c) the coding sequence of the gene encoding the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 19, SEQ ID NO: 21, or the mature polypeptide coding sequence thereof.

[69] The isolated mutant of any one of paragraphs [66]-[68], wherein the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 20, SEQ ID NO: 22, or the mature polypeptide sequence thereof.

[70] The isolated mutant of any one of paragraphs [66]-[68], wherein the non-type I restriction modification system protein comprises or consists of SEQ ID NO: 20, SEQ ID NO: 22, or the mature polypeptide sequence thereof.

[71] The isolated mutant of any one of paragraphs [66]-[68], wherein the non-type I restriction modification system protein comprises or consists of SEQ ID NO: 20 or the mature polypeptide sequence thereof.

[72] The isolated mutant of any one of paragraphs [66]-[68], wherein the non-type I restriction modification system protein comprises or consists of SEQ ID NO: 20.

[73] The isolated mutant of any one of paragraphs [66]-[68], wherein the non-type I restriction modification system protein comprises or consists of the mature polypeptide sequence of SEQ ID NO: 20.

[74] The isolated mutant of any one of paragraphs [66]-[68], wherein the non-type I restriction modification system protein comprises or consists of SEQ ID NO: 22 or the mature polypeptide sequence thereof.

[75] The isolated mutant of any one of paragraphs [66]-[68], wherein the non-type I restriction modification system protein comprises or consists of SEQ ID NO: 22.

[76] The isolated mutant of any one of paragraphs [66]-[68], wherein the non-type I restriction modification system protein comprises or consists of the mature polypeptide sequence of SEQ ID NO: 22.

[77] The isolated mutant of any one of paragraphs [66]-[68], wherein the coding sequence of the gene encoding the non-type I restriction modification system protein hybridizes under at least low, medium, medium-high, high, or very high stringency conditions with the full-length complementary strand of SEQ ID NO: 19 or SEQ ID NO: 21.

[78] The isolated mutant of any one of paragraphs [66]-[68], wherein the coding sequence of the gene encoding the non-type I restriction modification system protein comprises a polynucleotide has at least 60%, e.g., at least 70%, at least 75%, at least 80%, at least 85%, at least 90%, at least 95%, at least 97%, at least 98%, at least 99%, or 100% sequence identity to SEQ ID NO: 19, SEQ ID NO: 21, or the mature polypeptide coding sequence thereof.

[79] The isolated mutant of any one of paragraphs [66]-[68], wherein the coding sequence of the gene encoding the non-type I restriction modification system protein comprises or consists of SEQ ID NO: 19, SEQ ID NO: 21, or the mature polypeptide coding sequence thereof.

[80] The isolated mutant of any one of paragraphs [66]-[68], wherein the coding sequence of the gene encoding the non-type I restriction modification system protein comprises or consists of SEQ ID NO: 19 or the mature polypeptide coding sequence thereof.

[81] The isolated mutant of any one of paragraphs [66]-[68], wherein the coding sequence of the gene encoding the non-type I restriction modification system protein comprises or consists of SEQ ID NO: 19.

[82] The isolated mutant of any one of paragraphs [66]-[68], wherein the coding sequence of the gene encoding the non-type I restriction modification system protein comprises or consists of the mature polypeptide coding sequence of SEQ ID NO: 19.

[83] The isolated mutant of any one of paragraphs [66]-[68], wherein the coding sequence of the gene encoding the non-type I restriction modification system protein comprises or consists of SEQ ID NO: 21, or the mature polypeptide coding sequence thereof.

[84] The isolated mutant of any one of paragraphs [66]-[68], wherein the coding sequence of the gene encoding the non-type I restriction modification system protein comprises or consists of SEQ ID NO: 21.

[85] The isolated mutant of any one of paragraphs [66]-[68], wherein the coding sequence of the gene encoding the non-type I restriction modification system protein comprises or consists of the mature polypeptide coding sequence of SEQ ID NO: 21.

[86] The isolated mutant of any one of paragraphs [66]-[85], wherein disruption occurs in the coding sequence of the gene encoding the non-type I restriction modification system protein.

[87] The isolated mutant of any one of paragraphs [66]-[85], wherein disruption occurs in a promoter sequence of the gene encoding the non-type I restriction modification system protein.

[88] The isolated mutant of any one of paragraphs [66]-[87], wherein the mutant produces at least 25% less (e.g., at least 50% less, at least 60% less, at least 70% less, at least 80% less, or at least 90% less) of the non-type I restriction modification system protein encoded by the disrupted gene compared to the parent *Lactobacillus* strain when cultivated under identical conditions.

[89] The isolated mutant of any one of paragraphs [66]-[88], wherein the endogenous gene encoding the non-type I restriction modification system protein is inactivated.

[90] An isolated mutant of a parent *Lactobacillus* strain, comprising a disruption to an endogenous gene encoding a non-type I restriction modification system protein.

[91] The isolated mutant of paragraph [90], wherein the non-type I restriction modification system protein is a Type IV restriction modification system protein.

[92] The isolated mutant of paragraph [90] or [91], wherein (a) the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 20, SEQ ID NO: 22, or the mature polypeptide sequence thereof; (b) the coding sequence of the gene encoding the non-type I restriction modification system protein hybridizes under at least low, medium, medium-high, high, or very high stringency conditions with the full-length complementary strand of SEQ ID NO: 19 or SEQ ID NO: 21; or (c) the coding sequence of the gene encoding the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 19, SEQ ID NO: 21, or the mature polypeptide coding sequence thereof.

[93] The isolated mutant of any one of paragraphs [90]-[92], wherein the non-type I restriction modification system protein has at least 60%, e.g., at least 70%, at least 75%, at least 80%, at least 85%, at least 90%, at least 95%, at least 97%, at least 98%, at least 99%, or 100% sequence identity to SEQ ID NO: 20, SEQ ID NO: 22, or the mature polypeptide sequence thereof.

[94] The isolated mutant of any one of paragraphs [90]-[92], wherein the non-type I restriction modification system protein comprises or consists of SEQ ID NO: 20, SEQ ID NO: 22, or the mature polypeptide sequence thereof.

[95] The isolated mutant of any one of paragraphs [90]-[92], wherein the non-type I restriction modification system protein comprises or consists of SEQ ID NO: 20 or the mature polypeptide sequence thereof.

[96] The isolated mutant of any one of paragraphs [90]-[92], wherein the non-type I restriction modification system protein comprises or consists of SEQ ID NO: 20.

[97] The isolated mutant of any one of paragraphs [90]-[92], wherein the non-type I restriction modification system protein comprises or consists of the mature polypeptide sequence of SEQ ID NO: 20.

[98] The isolated mutant of any one of paragraphs [90]-[92], wherein the non-type I restriction modification system protein comprises or consists of SEQ ID NO: 22 or the mature polypeptide sequence thereof.

[99] The isolated mutant of any one of paragraphs [90]-[92], wherein the non-type I restriction modification system protein comprises or consists of SEQ ID NO: 22.

[100] The isolated mutant of any one of paragraphs [90]-[92], wherein the non-type I restriction modification system protein comprises or consists of the mature polypeptide sequence of SEQ ID NO: 22.

[101] The isolated mutant of any one of paragraphs [90]-[92], wherein the coding sequence of the gene encoding the non-type I restriction modification system protein hybridizes under at least low, medium, medium-high, high, or very high stringency conditions with the full-length complementary strand of SEQ ID NO: 19 or SEQ ID NO: 21.

[102] The isolated mutant of any one of paragraphs [90]-[92], wherein the coding sequence of the gene encoding the non-type I restriction modification system protein comprises a polynucleotide has at least 60%, e.g., at least 70%, at least 75%, at least 80%, at least 85%, at least 90%, at least 95%, at least 97%, at least 98%, at least 99%, or 100% sequence identity to SEQ ID NO: 19, SEQ ID NO: 21, or the mature polypeptide coding sequence thereof.

[103] The isolated mutant of any one of paragraphs [90]-[92], wherein the coding sequence of the gene encoding the non-type I restriction modification system protein comprises or consists of SEQ ID NO: 19, SEQ ID NO: 21, or the mature polypeptide coding sequence thereof.

[104] The isolated mutant of any one of paragraphs [90]-[92], wherein the coding sequence of the gene encoding the non-type I restriction modification system protein comprises or consists of SEQ ID NO: 19 or the mature polypeptide coding sequence thereof.

[105] The isolated mutant of any one of paragraphs [90]-[92], wherein the coding sequence of the gene encoding the non-type I restriction modification system protein comprises or consists of SEQ ID NO: 19.

[106] The isolated mutant of any one of paragraphs [90]-[92], wherein the coding sequence of the gene encoding the non-type I restriction modification system protein comprises or consists of the mature polypeptide coding sequence of SEQ ID NO: 19.

[107] The isolated mutant of any one of paragraphs [90]-[92], wherein the coding sequence of the gene encoding the non-type I restriction modification system protein comprises or consists of SEQ ID NO: 21, or the mature polypeptide coding sequence thereof.

[108] The isolated mutant of any one of paragraphs [90]-[92], wherein the coding sequence of the gene encoding the non-type I restriction modification system protein comprises or consists of SEQ ID NO: 21.

[109] The isolated mutant of any one of paragraphs [90]-[92], wherein the coding sequence of the gene encoding the non-type I restriction modification system protein comprises or consists of the mature polypeptide coding sequence of SEQ ID NO: 21.

[110] The isolated mutant of any one of paragraphs [90]-[92], wherein disruption occurs in the coding sequence of the gene encoding the non-type I restriction modification system protein.

[111] The isolated mutant of any one of paragraphs [90]-[92], wherein disruption occurs in a promoter sequence of the gene encoding the non-type I restriction modification system protein.

[112] The isolated mutant of any one of paragraphs [90]-[111], wherein the mutant produces at least 25% less (e.g., at least 50% less, at least 60% less, at least 70% less, at least 80% less, or at least 90% less) of the non-type I restriction modification system protein encoded by the disrupted gene compared to the parent *Lactobacillus* strain when cultivated under identical conditions.

[113] The isolated mutant of any one of paragraphs [90]-[112], wherein the endogenous gene encoding the non-type I restriction modification system protein is inactivated.

[114] The isolated mutant of any one of paragraphs [1]-[113], wherein the mutant has improved transformation efficiency compared to the parent *Lactobacillus* strain when cultivated under identical conditions.

[115] The isolated mutant of paragraph [114], wherein the mutant has improved transformation efficiency using pSJ10762, pTRGU1065, or pTRGU1073 as the transformant DNA compared to the parent *Lactobacillus* strain when cultivated under identical conditions.

[116] The isolated mutant of any one of paragraphs [1]-[115], wherein the mutant is capable of producing at least 10-fold (e.g., at least 100-fold, at least 1000-fold, at least 10000-fold, or at least 100000-fold) more transformants compared to the parent *Lactobacillus* strain when transformed and cultivated under identical conditions.

[117] The isolated mutant of any one of paragraphs [1]-[116], wherein the *Lactobacillus* strain is selected from *Lactobacillus plantarum*, *Lactobacillus fructivorans*, and *Lactobacillus reuteri*.

[118] The isolated mutant of paragraph [117], wherein the *Lactobacillus* strain is a *Lactobacillus reuteri* strain.

[119] A method for obtaining the isolated mutant of any one of paragraphs [1]-[118], comprising disrupting in a parent *Lactobacillus* strain the endogenous gene encoding the type I restriction modification system subunit or the non-type I restriction modification system protein.

[120] A method for obtaining the isolated mutant of any one of paragraphs [1]-[118], comprising: (a) cultivating a parent *Lactobacillus* strain; (b) disrupting the endogenous gene encoding the type I restriction modification system subunit or non-type I restriction modification system protein in a parent *Lactobacillus* strain of (a); and (c) isolating the mutant strain resulting from (b).

[121] A method for obtaining a *Lactobacillus* transformant, comprising transforming a heterologous polynucleotide into the isolated *Lactobacillus* mutant of any one of paragraphs [1]-[118].

[122] A method for obtaining a *Lactobacillus* transformant, comprising: (a) cultivating the isolated *Lactobacillus* mutant of any one of paragraphs [1]-[118]; (b) transforming a heterologous polynucleotide into the *Lactobacillus* mutant of (a); and (c) isolating the transformant strain resulting from (b).

[123] The method of paragraph [121] or [122], further comprising repairing the disruption to the endogenous gene encoding the type I restriction modification system subunit or non-type I restriction modification system protein.

[123] A *Lactobacillus* transformant produced by the method of any one of paragraphs [121]-[123].

[125] A method of producing a polypeptide, comprising: (a) cultivating the *Lactobacillus* transformant of paragraph [124]; wherein the heterologous polynucleotide encodes the polypeptide; and (b) recovering the polypeptide.

[126] A method of producing a fermentation product, comprising: (a) cultivating the *Lactobacillus* transformant of paragraph [124]; wherein the heterologous polynucleotide encodes a polypeptide of the fermentation pathway and wherein the transformant is capable of producing the fermentation product; and (b) recovering the fermentation product.

[127] The method of paragraph [126], wherein the fermentation product is an alcohol, an alkane, a cycloalkane, an alkene, an amino acid, a gas, an isoprenoid, a ketone, an organic acid, or a polyketide.

[128] The method of any one of paragraph [127], wherein the fermentation product is propanol (e.g., isopropanol or n-propanol).

SEQUENCE LISTING (518 sequences)

SEQ ID NO: 1 - DNA, 1128 bp, Lactobacillus reuteri
atgatttataaatacttaggagatattgctgagattaaaggtggcaaaagaatgcctaaaggaactagattgcaacaagaaaaaaatcaacatccgtatttaaggattactgattatgatggtaaaagttttgatcgtaatagtattagatatgttcctgatgaggtgtttgaaaagattagtaactatacagtaacagagggagatatttttttatcaattgttggaactatagggatagcgaccacgattgataaagaatatgataatgctaatctaacagaaaatgcagttaaaataattcctgatgagtcggtaaattccaaatatattttatattttttacaatcgatgttaggacaaagacaaatgaatgaactttctgttggctcaacacaaaaaaagttgcctataaaaaacattaaaaaaatcaagattcttttacctaatttagaaatacaaaataaagttgtatctaatttacaaatcttagataaaaaaatagctttgaacaatcaaataaatgataatttagatgctttattaactaatatattcaaaaaatatatgattaatgacggttttgaaaaatcaaacttaactcaaattgcaaattataaaaatgggttagctatgcaaaagtatagacctaattctaatgaagaaagcttaccagttcttaaaataaaagagttaaatcaaggaaatactgatgattcgtccgatagatgttcggctaatcttgataattctgtaatagttaatactggcgacataattttttcgtggtcaggaactttattagtaaaaaattggacgggagacaaggcaggtcttaatcaacatttatttaaggttacctctaataagtatcctgcatggtttatttatgaatggactaagtatcatttattgaggtttcaagcaattgccgccggaaaagctacaaccatgggtcatatcaaaagaagtgatttaaaatcatcactagtatatattccctctcaattatttttagcgaaaatggatagtcaactagcaccaatttatagtcaaaggttaaacctaattaaagaaaatcaacaattatcgaaacttaagcagactttgcttaagaaatatttttaa

SEQ ID NO: 2 - protein, 375 aa, Lactobacillus reuteri
MIYKYLGDIAEIKGGKRMPKGTRLQQEKNQHPYLRITDYDGKSFDRNSIRYVPDEVFEKISNYTVTEGDIFLSIVGTIGIATTIDKEYDNANLTENAVKIIPDESVNSKYILYFLQSMLGQRQMNELSVGSTQKKLPIKNIKKIKILLPNLEIQNKVVSNLQILDKKIALNNQINDNLDALLTNIFKKYMINDGFEKSNLTQIANYKNGLAMQKYRPNSNEESLPVLKIKELNQGNTDDSSDRCSANLDNSVIVNTGDIIFSWSGTLLVKNWTGDKAGLNQHLFKVTSNKYPAWFIYEWTKYHLLRFQAIAAGKATTMGHIKRSDLKSSLVYIPSQLFLAKMDSQLAPIYSQRLNLIKENQQLSKLKQTLLKKYF

SEQ ID NO: 3 - DNA, 588 bp, Lactobacillus reuteri
atgaaatataaaaaaatacagcttaaggatgtagctgatatagttatgggacaatcacccaagtcagtcttttacaatactaatggaaatggtactccgtttcttcaaggagtaagaacatttggtgaaaattatccccaaattgatacatggactacttcttataatagaaaagcgaaaagcggagaaatattgtttagtgtgagggcacctgttgggagagtaaactgggctaatcaagatcttgcagtagggcgtggattagcagctttaaaaattaaaagtggctattcaaaagaatacttatactatctttttaagaagattggtggtcaattagattcactagctactggaacagtatttacttcaataaataaaaaagaattggaagctatagagctaaaaattcctgttaatttaagtgatcaagaaaaaatagctgattatttacagaagattgatcaggaaatagagttaaataatcagataaatgataatttagatgttaaaaatacttttctaacagctctttttttattgctaataatttttcgttttcttcttctaattttcttaattgtttaa

SEQ ID NO: 4 - protein, 195 aa, Lactobacillus reuteri
MKYKKIQLKDVADIVMGQSPKSVFYNTNGNGTPFLQGVRTFGENYPQIDTWTTSYNRKAKSGEILFSVRAPVGRVNWANQDLAVGRGLAALKIKSGYSKEYLYYLFKKIGGQLDSLATGTVFTSINKKELEAIELKIPVNLSDQEKIADYLQKIDQEIELNNQINDNLDVKNTFLTALFLLLIIFRFLLLIFLIV

SEQ ID NO: 5 - DNA, 654 bp, Lactobacillus reuteri
ataatacaccacagagagttgcttagtagattaaatgataatttagttgaattagttgattcatattttataaatttcctaaataatgtaacaacagtagaaaaaactattgaagatattggtacagtagttggtggtggtactccgtctaaaaaaatagctgcttattggaatggagatattgcttgggtaactcccaaagatctgtctcaacatccgttaatttttacttcaagtggtgaaaattacattacaggtttaggattggcaaaaggaagtgcaaaattattgccaaccaatactatactatttagctctcgagcacctattggttatatttctatagctaaaaataatttagctacaaaccaaggcttcaagtctgtaatccctaataaagaatattcatttcaatttatttatgaattattaaagcacgaaactgctgcaataaaaaatgaagctaatggttctacattcaaagaaatatcaggtaaaaaactcaaacagcatataattaatattcctaattcagaagatacttctaagtttaacgaaattacaaaaccaatttttaaacaattaagaaaattagaagaagaaaacgaaaaattattagcaataaaaaaagagctgttagaaaagtatttttaa

SEQ ID NO: 6 - protein, 217 aa, Lactobacillus reuteri
MIHHRELLSRLNDNLVELVDSYFINFLNNVTTVEKTIEDIGTVVGGGTPSKKIAAYWNGDIAWVTPKDLSQHPLIFTSSGENYITGLGLAKGSAKLLPTNTILFSSRAPIGYISIAKNNLATNQGFKSVIPNKEYSFQFIYELLKHETAAIKNEANGSTFKEISGKKLKQHIINIPNSEDTSKFNEITKPIFKQLRKLEEENEKLLAIKKELLEKYF

SEQ ID NO: 7 - DNA, 3126 bp, Lactobacillus reuteri
gtggcaagttatcttaacgaagaaaatatagagggcattgctttaagatgtcttgatgaagtaggctatcaagtctacaaaagtgctagttatactagtccgaatgtagaaatagatgctgaaagaaataatgaccatacacaacctattttaaaaggacaattagaaaacgctttacgcaagttaaattctggacttgatgatgaagtataccgtaatgccattcatcaatttgaaatgctagcagatagcccagatatgatgcttaataaccataaacttcatgaattaattatcggcggagcaaaagtaaaaacatcaattaaaggtgaggaccggaccattactttgtatccgattgattttaaaaacgttgataacaatacatttattgcaacaaatcaatttacaatgaaacaaggagaacatgaaagaagaccagacattactctttttattaatgggcttcctttagttacctttgaattaaagaacccagcaaatgcgaatgtaggtattcaacaagcttttgcccaattttctacttataaagaagaaatatcttcttatatgcaatataacgaaattttaattgtttctgatggaattaatgcgcgagctgggtcattaacagcgggaattgatcgctttatgcggtggcgcgagccgaaaaatgtagatattgacgattcaatgatggaattagaagtattgataaaatacatgcttaccccatctgatttattaaacatcattcagaattttattctttttgaaagtgatggagacaagacaatcaagattttagcagcatatcatcaatactatatggttaataaagctgtaaaaagaacatcaaaagtattggctgaccctgatgacaaacgaattggtgttgtttggcataccactggttctggtaaatcattgtcgatggtcttttattctggaatagtagctcgtaaacttggtaatccaactattttagtaattaatgatcgtaatgatttagatgatcagttatttggtacttttgcggctgctcatgaatatctacaacaaaaccctgatcacgctgaatcacgaggagaagttcgtaaatacatgagtaagaattctggcgggattgtttttagtacaattcaaaaattctcaccaaactttgacgcaggtgaagaacatatgcctatacttacaaaccgttctaacgttatcgtaatggttgatgaagctcatcggtctcaatatggaatgcaagcaaaactaaccgataatggtattcgttatggatatgctaaatatttgcgtgaggctcttcctaacgcctcgtttattggttttacaggaacaccaataaatactgaagataaatctaccgtggcaatgtttggaaattacattgatgtttatgatattactcaagcagttaatgatcatgccacggtccggatttattatgaaagtcacgttttcccattaaagcttaaggacaatgcaattgatgaatatcaaaagttaattaaagaagctggtattaatgacgatcctaatcttagagaaactgagcgacggaatcgggcatttactagattagaggcccttgccggtgcaaaaccacggttagaaaaaatagcccaacactttgttcatcattttgaatcacgacaaaaggaagaatttggtaagtcgatgattgttgaaatgtcacgacaaaatgcagtaaagctatataatgaaattgcaaaattacgtcctgagtggataaatgatgatattcataagggaaaaatcaaagttattatgacgtctaatgcttctgatggcccagaatttgctaaatttaagacaagcaaacaagaccgatttacgttacaacaacggatgaaagataacgatgacgaattacaaattgtaatagttgttgatatgtggctaactggatttgatgttcctagcatgaataccatgtacattgacaagccaatgcaaggacataatcttatccaggcaattgctcgtgttaatcgagtatttaagaataaagatagtgggttaattgtcgattacattgggattgctgatgctcttcgttttgccttaaatgtatacacaaaagatgaccaaggaaaagttggaattaatgttgatcgtgcactaatgcttctaaaagagaaatatgacattattaaagaagatttcctatatgggattgattactcagaatttgattctgatgatagccaaactcgtcagaaggcagttactcgtgttgtaaatgaattagctgcagaggacgatgaaacaaaacaaaaattctttgatgtagtaacagaacttcaaaaagcttatgcattagtttcaacacagccggaagcccaagatttaagtgcggagatagcattctttaaaacggttaaagtattcttaactaagcttgaggctcctgacgatccagatgatagtaaagagattcatagttctgttgattatcgaatgcaacaactattagatcaatcaattatttcagagccgaacgttgacatttatcgtgacctaggattagaacgccctaacttagatttaatctcagaacaatttcttgaaaaagtaaatgaaattactgagaaagatctagcaattactcttttagagaaactattaaaagggcaagtaaaagcctaccaaaaaacgaatattgttaaaggcaagaagtttgaggaattacttcaagagtcaattgatgattacaataggcggggaattaccagtgaaattgtaattagaaagttaattgatatggctaaggaaattaataaagaacaacaagaaggtaagaatctgggactttcaaaagaagaagttgccttttatgatgctttagctgatcatgagaaagctgttcaagaattaggagaagaaaagttacatcttattgctgctgaattagtaaagactgtaaagcaacaatcaggggttgattgggagcggcgcagcaatgttcgtgctaaaatgcgtgttgcagttaaacatctattacgtaagtatggttatccacctgatattgctccagatgccattaagaccgtagtaaagcaagctgaacaaatggcttctcaagagagctaa

SEQ ID NO: 8 - protein, 1041 aa, Lactobacillus reuteri
MASYLNEENIEGIALRCLDEVGYQVYKSASYTSPNVEIDAERNNDHTQPILKGQLENALRKLNSGLDDEVYRNAIHQFEMLADSPDMMLNNHKLHELIIGGAKVKTSIKGEDRTITLYPIDFKNVDNNTFIATNQFTMKQGEHERRPDITLFINGLPLVTFELKNPANANVGIQQAFAQFSTYKEEISSYMQYNEILIVSDGINARAGSLTAGIDRFMRWREPKNVDIDDSMMELEVLIKYMLTPSDLLNIIQNFILFESDGDKTIKILAAYHQYYMVNKAVKRTSKVLADPDDKRIGVVWHTTGSGKSLSMVFYSGIVARKLGNPTILVINDRNDLDDQLFGTFAAAHEYLQQNPDHAESRGEVRKYMSKNSGGIVFSTIQKFSPNFDAGEEHMPILTNRSNVIVMVDEAHRSQYGMQAKLTDNGIRYGYAKYLREALPNASFIGFTGTPINTEDKSTVAMFGNYIDVYDITQAVNDHATVRIYYESHVFPLKLKDNAIDEYQKLIKEAGINDDPNLRETERRNRAFTRLEALAGAKPRLEKIAQHFVHHFESRQKEEFGKSMIVEMSRQNAVKLYNEIAKLRPEWINDDIHKGKIKVIMTSNASDGPEFAKFKTSKQDRFTLQQRMKDNDDELQIVIVVDMWLTGFDVPSMNTMYIDKPMQGHNLIQAIARVNRVFKNKDSGLIVDYIGIADALRFALNVYTKDDQGKVGINVDRALMLLKEKYDIIKEDFLYGIDYSEFDSDDSQTRQKAVTRVVNELAAEDDETKQKFFDVVTELQKAYALVSTQPEAQDLSAEIAFFKTVKVFLTKLEAPDDPDDSKEIHSSVDYRMQQLLDQSIISEPNVDIYRDLGLERPNLDLISEQFLEKVNEITEKDLAITLLEKLLKGQVKAYQKTNIVKGKKFEELLQESIDDYNRRGITSEIVIRKLIDMAKEINKEQQEGKNLGLSKEEVAFYDALADHEKAVQELGEEKLHLIAAELVKTVKQQSGVDWERRSNVRAKMRVAVKHLLRKYGYPPDIAPDAIKTVVKQAEQMASQES

SEQ ID NO: 9 - DNA, 1533 bp, Lactobacillus reuteri
ttggcaacaaagtctaaagagctaaatattgaagataaattatggaaggctgctgatgcattgcgtggaagtatggatgcatcagaatatcgtaatgttgtattaggattgatctttcttaaatatgcgtcagattcctttgaagaaagaagacaagaacttttaaaaacagaatatcctgaagatgcagaagatccggatatgtatctagaaaataatattttctgggttcctcaagaggctcgttgggcaaagattgaacatgctgctaaaacacctcaaattggtgaagtgattgatgatgcaatgactgcaattgaaaagagcaatgattcatttcgagggattttgagtaaaaactatgcttcaccagatcttgataaaacacgcttgggtgaagtagttgatttaatttcggacattaaggttggaactaaagaatctacagataaagatgttttaggtcgtgtttacgaatatttcttaaatgaatttgctagtcaagagggtaaacacggtggtgagttctatacaccacggtcaattgttaaaatcttagttgaaatgattgagccttataaaggacgtatttatgatccttgttgtggttcaggtggaatgtttgtccaatcagaagagttcgttcgtcatcatcagggagagttgaaagatcttcacgtatttggtgaggaatctaacccaactacttggaaattagctaagatgaatttagcgattagaggaattgatagcgacttaggcccccaccaaggcgacactttcactaatgatttacataaaggtgttcgtttcaactacattttggctaatccaccattcaacattaaaaactggggtggcgaaaagcttcaagaagatgctagatggaaatatggtgttccaccaacaggaaatgcaaattatgcctggattgaacatattattagtaagttagcaccggatgggaaagctggctttgttttagctaacggtgccttatcgacttctaataaagaagagtttgctattcgtaaagcaattttagaagatgataagattgatgcaattgttgctttacctgaaaaaatgttttattcaacggggattccagtttcattatggtttgttgatatgaataaggaatctgaggatgaacgctcgcgaaagggtgagacattatttattgatgcacgtaatttgggtgagatgattgatcgaactcatcgtgcatttaatgatgatgatattaaaaaagtagcggatacttaccatgcttatcgtggtacaaacgatcaagaatataaagatgttgctggcttttgtaaaattgctaagttagatgagatcgctaaaaatgattatgtattaacgcctggtcgctatgttggccttgctaaacaagaagatgatggagaatcatacgaagttaaaatgaagagactaactagtgaattaaaagaacaatttgaggagagtaataagttacaagctcaaattaaagatgtattgaaggagcttggatatgaaatataa

SEQ ID NO: 10 - protein, 510 aa, Lactobacillus reuteri
MATKSKELNIEDKLWKAADALRGSMDASEYRNVVLGLIFLKYASDSFEERRQELLKTEYPEDAEDPDMYLENNIFWVPQEARWAKIEHAAKTPQIGEVIDDAMTAIEKSNDSFRGILSKNYASPDLDKTRLGEVVDLISDIKVGTKESTDKDVLGRVYEYFLNEFASQEGKHGGEFYTPRSIVKILVEMIEPYKGRIYDPCCGSGGMFVQSEEFVRHHQGELKDLHVFGEESNPTTWKLAKMNLAIRGIDSDLGPHQGDTFTNDLHKGVRFNYILANPPFNIKNWGGEKLQEDARWKYGVPPTGNANYAWIEHIISKLAPDGKAGFVLANGALSTSNKEEFAIRKAILEDDKIDAIVALPEKMFYSTGIPVSLWFVDMNKESEDERSRKGETLFIDARNLGEMIDRTHRAFNDDDIKKVADTYHAYRGTNDQEYKDVAGFCKIAKLDEIAKNDYVLTPGRYVGLAKQEDDGESYEVKMKRLTSELKEQFEESNKLQAQIKDVLKELGYEI

SEQ ID NO: 11 - DNA, 1029 bp, Lactobacillus reuteri
ttgatagtgaaacttaaagatgtttgtataaaaggtacatcaaatatcaggcaaaaagatgtaaatgatagtggaagatatcctgtctatggagcagctggtccagtgggctttatgaattcttttcaatatgatgaaccatatgttggtgtggtaaaagatggggctggtattggccgagcaacatatttacctagcaattcctcaattattggaaccatgcaggctttgataccaaagaaaaatgtattacccaagtatttgtattacgcagtatcatctatgcatttagaaaaatactattctggtgctactattcctcatatatattttaaaaactataagcacgaaagatttgtattagtttcaaaaaaagaacaagaacaaattatttggagattttctttattagaaaaaatgataagtaataagcaacagcaattgcttaagctggacgaactaatcaaagcccgatttgtcgagatgtttggtgatccgattatcaacaataaaaatataaaaaagaaaaaactaggtgacatttgcttattaaaagctggcgactttaccccttctaaaaaaatatctcctgttaaaacatctattaataagtatccctgctttggaggaaatggtataagaggatatgttgataactatacacatcaaggaaattattctttaattggaagacaaggtgctttatgtggaaatgttaagtttgcaacgggaaaatttagaaatactgaacatgctattttagtaagtccgaatatagagattaacagtcgttggctatttgaactattaaacttggaaaaacttaatcgatttagatctggagcagctcaaccaggtctagcagttaaaacactaaatgagattattgttccagttgcagatttgaattcacaaaacgaatacgcaaactttgttcaacaagtcgacaaatcaaaagttgtaattcaaaaatcgcttgatgagacacaaaaattatatgatagcttaatgcaagaatattttgggtaa

SEQ ID NO: 12 - protein, 342 aa, Lactobacillus reuteri
MIVKLKDVCIKGTSNIRQKDVNDSGRYPVYGAAGPVGFMNSFQYDEPYVGVVKDGAGIGRATYLPSNSSIIGTMQALIPKKNVLPKYLYYAVSSMHLEKYYSGATIPHIYFKNYKHERFVLVSKKEQEQIIWRFSLLEKMISNKQQQLLKLDELIKARFVEMFGDPIINNKNIKKKKLGDICLLKAGDFTPSKKISPVKTSINKYPCFGGNGIRGYVDNYTHQGNYSLIGRQGALCGNVKFATGKFRNTEHAILVSPNIEINSRWLFELLNLEKLNRFRSGAAQPGLAVKTLNEIIVPVADLNSQNEYANFVQQVDKSKVVIQKSLDETQKLYDSLMQEYFG

SEQ ID NO: 13 - DNA, 1119 bp, Lactobacillus reuteri
atggagtataaaaaatttacagcgctttttaccgatgtgactaaaacaggaacaaaaatccccaaagatgaatatttaactacgggaaaaaatataataattgatcaaggaaaagatagtattgcaggatatacagatcgtcaaaaaggtatatttgaagaggtcccagtgatagtttttggagatcatacaagaatagtgaaatatattgataaacctttttttcttggtgcagatggagtgaaagtattaaagagtaaggaaaaagaatctaactataaatatttatactatgctttaaaagcagcacatattccaaatacgggatataatcgtcattttaaatggcttaagcaaataaatatgaattatccggaccttaacgaacaaaaaaatatagttgatattcttgatagtttaactcgaattattaaagttagacaaaaagaattagccttttttgacaaactaatcaaagcccgatttgtcgagatgtttggtgatccgataagtaataaaaaaagctggaagaaacgattattaaatgatttagttgataagattggctctggcgccactcctaaaggtggaaaagaaagctatcaagatcatggcatcagttttataaggagtatgaatgttcatgacggatacttcaattacaaggatttagcttatataaattcaacacaagccaagcaactttcaaatgtaatagtgcagtctcaagatgtatttataaatattacaggagcttctgttgctagatcttgtattgtacctgatgatatattacctgcacgagtgaatcagcatgtttctattattaggtgcaaatcggatgtattgaatccaatctttattaataatttgtttcttaatgattcttttaaaagaatattattgtctattggtttatcgggtggggcaacgagacaagcaattactaaaaagcaacttgaaatgttaaaaattatacttccaccaatttccctccaaaatgaatacgcaaacttcgtccaccaagtcgacaaatcaaaatttgaaaatatagtatacttaaataaaacgctcttaaacaaaattcttagtcaaataggagatgttatccgtgactaa

SEQ ID NO: 14 - protein, 372 aa, Lactobacillus reuteri
MEYKKFTALFTDVTKTGTKIPKDEYLTTGKNIIIDQGKDSIAGYTDRQKGIFEEVPVIVFGDHTRIVKYIDKPFFLGADGVKVLKSKEKESNYKYLYYALKAAHIPNTGYNRHFKWLKQINMNYPDLNEQKNIVDILDSLTRIIKVRQKELAFFDKLIKARFVEMFGDPISNKKSWKKRLLNDLVDKIGSGATPKGGKESYQDHGISFIRSMNVHDGYFNYKDLAYINSTQAKQLSNVIVQSQDVFINITGASVARSCIVPDDILPARVNQHVSIIRCKSDVLNPIFINNLFLNDSFKRILLSIGLSGGATRQAITKKQLEMLKIILPPISLQNEYANFVHQVDKSKFENIVYLNKTLLNKILSQIGDVIRD

SEQ ID NO: 15 - DNA, 3336 bp, Lactobacillus reuteri
atgttatccgtgactaactttgattatttactagaagaaccacaatttaaagatttcgtgcaaatagcaatagcagctgaaaaagtagccgttattgatcctgcaacagcagtaattgactgtcgacgtgcaatggaattagcggttaagtggatgtattcagttgactcagacttaagaactccctatcaggataaattagtaaccttaatcaatactctagattttaaggatattgttgatcctaatacttggcaaggcctagaattaattcgtcgtttaggaaatattgctgtacacactaatagaaaagtatctctagatgaagctattttatgtttaaaagctttatttagcttttttgatatgcttgattattgttatggaagcaattatcaaaagaaagattttgacaagtcgattgttgggaattatcgtctggagtttgttcctaaagtctctccaatggaagagtcaacaatttctctcgaaaaacttacgaaaaagaacaaacctttacaggaatctttaactgcgcaaagaaaagtacaaggaaagagctatactcctaaaccatttggaatctcagagtttaaaactcgtaaaatttatattgatactatgctagctgaagtaggttggattgagggccaaaattggttaaacgaagtagaacttaaaggaatgcctaacaaagctggtactggatatgccgattacgtcttatatgatgatgcgcatcaacctcttgcagttattgaggcaaagaaaacttgtaaagatgtagcagttgggcgccaacaagcaaaactatatgcggatatattagagaataagtatggacgtagaccagttatatttttaagtaatggatttgaaacacgaattattgataatcaataccctgagagacaagtttcatcaatttattctaagcgtgatttagaaaagttgtttaatttgcaaaaagtacgccaacctttaacgaatattgtagtagatgataatattgcgggacgttattatcaaaaggctgccattcaagctgtttgcgaaagtttttcaaaagaaaatagacgtaaagctttattagtcatggcgacaggatccggtaaaacaagaactgcagttggattagttaaagttcttttaaacgctggttggattaaacatattttatttttagccgatagagatgctttagtgacacaggctaaaaggagctttgtcaatttactacctgatctttccgtaactaatttagttgaagataagaaaaattataacgctcgatgtgttttttctacctatgcaacaatgatgaatgtcattgatacagcaatagatgacgaaaagcaaaaactgtatacagcaggacattttgacttaattattgtcgatgaggctcaccgatcaatctataataaatatagaaatatctttacttactttgatgcaccattagttgggctaactgctacccctaaagatgatattgataaaaatacctattctatttttaacttggaagatggagtgcccacttatgggtatgatctagcagaagctgttaaagataagtgtttagtaccctacagatcaatagagacccgcttaaaatttatggaaaagggtattaattatgacgatttaactgatcaagaaaaggaagaatatgaggaaactttcacagatgaagatggtgagctgccaaagaagattgaatcaagaaagttgaataagtggttatttaataaagacactattcgcaaagctttgaatattttaatgagtcagggactaaagattaattatggcgaaagaataggtaaaactattatctttgctaagaatcatcgccatgctgaggaaattctgaaagtttttaatgaagaatatcctcagttttgtaaaaatggtcaaccttatgcaaccgtaattgataattatactaattacgcacaaagtgcaattgatgaattttcagatccaaataaattaccacaaattgctatttccgtggatatgttggacacaggaattgatgtaccagaatgtttaaatttagtatttttcaaaaaagtaatgagtaaggcgaaattcttccagatgattggaagaggaacacgtttatgtccaaatttgttagatggaaaagataaagaagaattttacatttttgatttttgcgataactttcaatttttccgtatgaaaaagggacgtgaagcgggggcccaagaaacgttacaaagtgctttattcaatttgaaaatgaaattagtacggaaattacaagaagccccatatcaaacagaagattttaagcagtatcgaaactttttagttgaagatttatctaaaaaagttaaagaattaaatagaaaaaattttgctgttaaacaacatcttgcctatgttgataaattttctcaaatagataattacaataacttaacttatgaggacattgtaaatgttcaaaaagagttagcacctctaattcttccggataatgatgaaccaaatgccctacgctttgatgctttagtctataaaatggaactggcaaaaatgtcacaagaatcctatggacgattaaaagtagatctctgtaataaaatttctaaattatctgatttaatgactatcccacagattaaagcaaaagccgacttaattaaagttatgtcagagtcagaatatgttgaatctgcaaatgttcaagatttagagcatatccgtcaaaatatacgggacttaattcaatatcttccaaaaaagggagtagtgtattatacaaatttcactgatagtatattagattcaactgttcatgaagctgaacttgaaacttctactttgaaaaactacaaagcagaagcagaattttatattaagcaacatcaaagtgaaaatataatgtgtaaaattaaagataatgcacctttaaatagcagtgatataaaagagctcgagaatattctatggcaaaaacttggaagtaaagaagagtatcaaaaagaaataggaaataaaactcctggtgaatttgttcgtagtattgttggtttagatatgaaagctgccaaagaagcttttaataaatatttagatacagtttcacttaataaacagcagatatattttataaatgaaattatagagtatattgttaaaaatggtacattaactgatatgcatgttttacaggaatctccatttacaaatcaaggatcaatttcagaactctttgaatcagataaaaatatttggttcaaagtaaaaagagcaattgatgaaattaatagtaatgctggagttggcgtagcttaa

SEQ ID NO: 16 - protein, 1111 aa, Lactobacillus reuteri
MLSVTNFDYLLEEPQFKDFVQIAIAAEKVAVIDPATAVIDCRRAMELAVKWMYSVDSDLRTPYQDKLVTLINTLDFKDIVDPNTWQGLELIRRLGNIAVHTNRKVSLDEAILCLKALFSFFDMLDYCYGSNYQKKDFDKSIVGNYRLEFVPKVSPMEESTISLEKLTKKNKPLQESLTAQRKVQGKSYTPKPFGISEFKTRKIYIDTMLAEVGWIEGQNWLNEVELKGMPNKAGTGYADYVLYDDAHQPLAVIEAKKTCKDVAVGRQQAKLYADILENKYGRRPVIFLSNGFETRIIDNQYPERQVSSIYSKRDLEKLFNLQKVRQPLTNIVVDDNIAGRYYQKAAIQAVCESFSKENRRKALLVMATGSGKTRTAVGLVKVLLNAGWIKHILFLADRDALVTQAKRSFVNLLPDLSVTNLVEDKKNYNARCVFSTYATMMNVIDTAIDDEKQKLYTAGHFDLIIVDEAHRSIYNKYRNIFTYFDAPLVGLTATPKDDIDKNTYSIFNLEDGVPTYGYDLAEAVKDKCLVPYRSIETRLKFMEKGINYDDLTDQEKEEYEETFTDEDGELPKKIESRKLNKWLFNKDTIRKALNILMSQGLKINYGERIGKTIIFAKNHRHAEEILKVFNEEYPQFCKNGQPYATVIDNYTNYAQSAIDEFSDPNKLPQIAISVDMLDTGIDVPECLNLVFFKKVMSKAKFFQMIGRGTRLCPNLLDGKDKEEFYIFDFCDNFQFFRMKKGREAGAQETLQSALFNLKMKLVRKLQEAPYQTEDFKQYRNFLVEDLSKKVKELNRKNFAVKQHLAYVDKFSQIDNYNNLTYEDIVNVQKELAPLILPDNDEPNALRFDALVYKMELAKMSQESYGRLKVDLCNKISKLSDLMTIPQIKAKADLIKVMSESEYVESANVQDLEHIRQNIRDLIQYLPKKGVVYYTNFTDSILDSTVHEAELETSTLKNYKAEAEFYIKQHQSENIMCKIKDNAPLNSSDIKELENILWQKLGSKEEYQKEIGNKTPGEFVRSIVGLDMKAAKEAFNKYLDTVSLNKQQIYFINEIIEYIVKNGTLTDMHVLQESPFTNQGSISELFESDKNIWFKVKRAIDEINSNAGVGVA

SEQ ID NO: 17 - DNA, 1554 bp, Lactobacillus reuteri
atgattgcaggagaactaaaaagtaagattgatggtttatgggaaacctttgcaacgggaggcctaaccaatccattgaatgtaattgaacaaattacatatttaatgtttatcaaggacttggatgattcagataatagaagaaaaaaggataatatcttattaggattgaacgattatcagtctatttttgatggagaggtaaaaattgatgatgatctaacagttaatggcgatgagctaagatggtccacatttaaagattttgcacctgaaaagatgtttactattgttcaaacagaggtatttccattcattaagaatttgaaaaataatgaagaaggttcgtatgctcgctacatgaaagatgcaactttcctcatcccaactcccggtctactatctaaggtgattggagaattagatgatatttaccgactgatggatgaagaagttcaaaaagataactctaaaaataaagagaaagctctgattataaacagaggagacgttcgtggggatgtatacgaatatcttttaggaaagttgtctactgcaggtagaaatggtcaatttagaactccacgtcacattatcaaaatgattgtggaattaatgaatccgcaagttactgataaaatttgtgatccagctgcaggaacagcgggtttcttagtagaaagtgctgaattccttcaagataagaagaaagaagaaattttttataataaagaaaatcgacattattttcataatgaaatgtttacaggatacgatactgatcaaaccatgcttcgtatcggagctatgaatatgttatctcatggagtggataatcctaatgttgagtatcaagatagtttatctgaacaaaatacggatagagatgaatattctttaattatggctaatcctccatttaagggaagcctagattataattcagtttcaaaagacctgcttaaaatttgtaaaactaaaaaaacagaattactttttgtaactttattcttacaaatgctaaaagtgggtggaagatgtgcctgtattgttccagatggtgttttatttggatcatctaaggcacataagtcaattagaaaagaaataattgaaaataacaatttagaagcagttatttcaatgccttccggagtgtttaagccttatgctggagtttcaactgccatcttgatttttactaagacaggtaatggaggaactgataaagtttggttctatgatatgactgctgatggattttctcttgatgacaagagaacgccagttaaagaaaatgatatacctgatattattgaacgttttaatcatctagataaagaggttgaccgtaaaaagacaaataaatcctttatggttgataagaaagatattgttgacaatgattatgatctttcaattaatcggtataaagaaattgagtataaaccagttaaatatccaccaacagaagagattattgctgaaattgaaaagttagataaggaagcaaatgacgcattacaagagttaaaagctcttttaaaagactag

SEQ ID NO: 18 - protein, 517 aa, Lactobacillus reuteri
MIAGELKSKIDGLWETFATGGLTNPLNVIEQITYLMFIKDLDDSDNRRKKDNILLGLNDYQSIFDGEVKIDDDLTVNGDELRWSTFKDFAPEKMFTIVQTEVFPFIKNLKNNEEGSYARYMKDATFLIPTPGLLSKVIGELDDIYRLMDEEVQKDNSKNKEKALIINRGDVRGDVYEYLLGKLSTAGRNGQFRTPRHIIKMIVELMNPQVTDKICDPAAGTAGFLVESAEFLQDKKKEEIFYNKENRHYFHNEMFTGYDTDQTMLRIGAMNMLSHGVDNPNVEYQDSLSEQNTDRDEYSLIMANPPFKGSLDYNSVSKDLLKICKTKKTELLFVTLFLQMLKVGGRCACIVPDGVLFGSSKAHKSIRKEIIENNNLEAVISMPSGVFKPYAGVSTAILIFTKTGNGGTDKVWFYDMTADGFSLDDKRTPVKENDIPDIIERFNHLDKEVDRKKTNKSFMVDKKDIVDNDYDLSINRYKEIEYKPVKYPPTEEIIAEIEKLDKEANDALQELKALLKD

SEQ ID NO: 19 - DNA, 2850 bp, Lactobacillus reuteri
atggacaattcagtgctgcaagacgcaattttgaatggacttattagtactcaatatcaaggtaatacgctgttaggtccgcaattattaaccaacaaccaatcatcgacaatttggcaaacgttacggcacgaattgctgtcatgtaaaaactttacgtggtcagtcgcctttattacgttagatatgttggttccatttaaggcagtgatggctgacttagcacagcagggggtacaagggacgatcattaccagtgattacttgaattttaatcaccccgcgatgtttgaagaattgcaaaagattcctaatttaacggttaggattgctgatcttaatggatttcatactaaggggtatttatttgatcatgggaaatatcagaccgtaattattgggagtgctaattttacacggtctgctttgttagttaataaggagtggaatttgaaattaagctcccgccaagaaggaagcctttttcaacaactaacggcggaattgaatgctgttaaacatgagagtaccgttctaacgtcagagtggattgcggagtatcgcaagaattggcaaccaccaaagactagggtgacgcaaccggaaaaattaaaaccaattgaacctaatcaaatgcaacaagccgctttaggacaattaagcactctgataaaaactggcgctaaaaaaggactggtcgtttcagcaacaggaactggaaaaacatatctgggagcgtttgctgtcaataaatatcagccgcgtcgtttcttatatgtcgttcatcgagaacaaattgccaaaaaatcgttagctagttttcgacgagttattggcggcaagaaaactgattacgggttattgacaggtaatcgccatgattggaatgctaaatatttatttgcaactgtccaaacactaagccaacaagcagtacttgataagctaaaagctaccgaatttgactacattttgatcgacgaggcccatcgtgcagcagcacctagttatcaacgaattttaaaccactttatgccgcaattttggttggggatgactgcaacccctgaacgaatggacaatcaagacgtctttaaactgtttgattatcatttggcctatgaaattcggctgaaagatgcattggctgctaaaatgttagcgccattccattacgtgggagttaccgattatgaagttgatggcgaagttattactgagacttctaagttaaaccaattgattgtttcgaaacgggttaattatgttcttaaccaattagactattatggatattgtggcgatcagcctcgtgggttagtattttgtagtcggcaggcagaggcaaaagaattggcagtccagtttaatgcggctaaccatcctgcgattgcattgacaaatcaaagtagtagtcaagagcgagcaaaggcagttgagcaattagaggcaggaaagattgagtatatcattaccgttgatctttttaatgaaggggtcgacatcccatcagtaaatcagattgtaatgatgcgtaatacccaatcaccaattgtgtttatccaacaactagggcgcggcttgcgtaaatatcctggtaaagattttgtgacagttattgattttattggaaattaccaacataattacatgattcctcttgcgcttaaccaggacaatagccgaagtaaggatcaagcgcggcgtgaagttaaggtgccaacgaattttgatgtttcaaccattaactttacgaaggttgccgaagaacaaattttagcctcccttgataaagttaaattggactcgatgcgtgaattgcggcaggcataccatgatttagctaaccaactagggagagcaccattgctgggtgacttttatcgttatggttctgttgatccccgagtatttgcgcaaaattcccaactcaaccattatggtgacttcttagaaaagatggggacagaacttaaattaactaagtatgagcgtcaagtactagcctttttaactaaagagttgcttaacggtaaacggccacatgaattgattctccttcaatgcttacttcgcggtacgtgttcaattgatgcttttaaagcagaattagagcagcaaaacattcgcgttacaccagctgttttacaatcagttgatgatattttaagcttgcaattctttaatgtaaaagctggtaaacagttaaaaaaggatcagtatggcggactgccgattattgatcatccagatttgttaacgtatcagttaaattcaaaaattcgagcaggactagaaagtgacaatgatttcaagtgcttgtttaccgatgtattaacaacgggtcttgaaatcgccaagcaatatgatctcaagcaagcatttaccctttatcagcaatatgaccgcaaagatgtttgtcgtttattaaattggcccctcgatgtaagtgcgccgttatatgggtatcgagtggcagaagatgtttgtccgattttcattacctaccataaggatgcggaagaaaaaaggaatgctatctataataatcaactacaagatggccgttcattgcgctggtacacacggacacctcgccatctttcatctgatgaggtccagcggttgcttgcaggagtaaaagagggtaagccgcaagtaaaattacacttgtttgtaaaacagagcgatgcagttggcaaagaattttattatttaggtcctgcttatgttcaaccggactccgtaagagaagaattagttgggccaaagaaaaaagcggcagtgggaatggatttagtcttagaacagccgttaaccccggcgatgatgaacctattagcaatataa

SEQ ID NO: 20 - protein, 949 aa, Lactobacillus reuteri
MDNSVLQDAILNGLISTQYQGNTLLGPQLLTNNQSSTIWQTLRHELLSCKNFTWSVAFITLDMLVPFKAVMADLAQQGVQGTIITSDYLNFNHPAMFEELQKIPNLTVRIADLNGFHTKGYLFDHGKYQTVIIGSANFTRSALLVNKEWNLKLSSRQEGSLFQQLTAELNAVKHESTVLTSEWIAEYRKNWQPPKTRVTQPEKLKPIEPNQMQQAALGQLSTLIKTGAKKGLVVSATGTGKTYLGAFAVNKYQPRRFLYVVHREQIAKKSLASFRRVIGGKKTDYGLLTGNRHDWNAKYLFATVQTLSQQAVLDKLKATEFDYILIDEAHRAAAPSYQRILNHFMPQFWLGMTATPERMDNQDVFKLFDYHLAYEIRLKDALAAKMLAPFHYVGVTDYEVDGEVITETSKLNQLIVSKRVNYVLNQLDYYGYCGDQPRGLVFCSRQAEAKELAVQFNAANHPAIALTNQSSSQERAKAVEQLEAGKIEYIITVDLFNEGVDIPSVNQIVMMRNTQSPIVFIQQLGRGLRKYPGKDFVTVIDFIGNYQHNYMIPLALNQDNSRSKDQARREVKVPTNFDVSTINFTKVAEEQILASLDKVKLDSMRELRQAYHDLANQLGRAPLLGDFYRYGSVDPRVFAQNSQLNHYGDFLEKMGTELKLTKYERQVLAFLTKELLNGKRPHELILLQCLLRGTCSIDAFKAELEQQNIRVTPAVLQSVDDILSLQFFNVKAGKQLKKDQYGGLPIIDHPDLLTYQLNSKIRAGLESDNDFKCLFTDVLTTGLEIAKQYDLKQAFTLYQQYDRKDVCRLLNWPLDVSAPLYGYRVAEDVCPIFITYHKDAEEKRNAIYNNQLQDGRSLRWYTRTPRHLSSDEVQRLLAGVKEGKPQVKLHLFVKQSDAVGKEFYYLGPAYVQPDSVREELVGPKKKAAVGMDLVLEQPLTPAMMNLLAI

SEQ ID NO: 21 - DNA, 960 bp, Lactobacillus reuteri
atgcgctcaaaaagaaataaaacaattgatttcacgcttgaggaggcttcacctgagctcctcagccagattattcacccaactgataatctccagacaatatccaacaagattatcaacggggattccttcaaagtaatgactcaactagcaccacaccaggttgatcttgcccttattgaccctccctataatcttaacaaacaatatgatggtttaaacttcaaaaagatgtctacgagccaatatcagacttacacgcaaaagtggattgatctcttaaagccattactaaaagaaaatgctagtatctatgtcttttctgattgggcaactagcatggcacttgcgccgatcctcgaaaaaaattttacaattcaaaatcggattacttggcaacgagaaaagggccggggctcacagaaaaattggaaaaacgggatggaggatatttggttcttgactgctaacccgagtgactatacctttaacgtcgaccaagttaaacaacgacggcaggtggtagccccttatcgtcaagatggggttgctaaagactggcaagctactaaaaacggtaattttcgtgatacaatgccctctaatttttgggacgatatttcaatcccctattggtcaatgccagaaaatactggtcaccctacgcaaaagccagaaaaattactggcaaaaattattcttgctagttctaatcccaatgactttatttttgatccttttgctggttccggttcgagtttagtgactgccgctaagcttaaccgccgttatcttggaatcgagcaaagtcttctatattgtgcatggggacagtaccggctcaatcaagtaaaggatgatcctagcatccaaggctacactgacggggtcttttgggaacgcaataccttggcagtacaacgaaaaattaaacgccaacaaagggcaagtgatgaataa

SEQ ID NO: 22 - protein, 319 aa, Lactobacillus reuteri
MRSKRNKTIDFTLEEASPELLSQIIHPTDNLQTISNKIINGDSFKVMTQLAPHQVDLALIDPPYNLNKQYDGLNFKKMSTSQYQTYTQKWIDLLKPLLKENASIYVFSDWATSMALAPILEKNFTIQNRITWQREKGRGSQKNWKNGMEDIWFLTANPSDYTFNVDQVKQRRQVVAPYRQDGVAKDWQATKNGNFRDTMPSNFWDDISIPYWSMPENTGHPTQKPEKLLAKIILASSNPNDFIFDPFAGSGSSLVTAAKLNRRYLGIEQSLLYCAWGQYRLNQVKDDPSIQGYTDGVFWERNTLAVQRKIKRQQRASDE

SEQ ID NO: 23 - DNA, 1479 bp, Lactobacillus acidophilus
atgtctaattttcaaacttcagaaaagaattatcaagaatatgctaaattggcttctagtgctgaatccttaatttattcagatcctagaagtagcgtaactgtatttggtacctttggtgaacagttaactaaagagattatgcacttagatgacatagttgactgggaactaaatcaaaaacaaagaattgaaaagttagctttatctagaaacgaatatccagcagtagtattaactgcattgaatgagattagatttaaacgaaacaaagcaacacatgatgatcagtttattgcaacaaaaagtgatgcgttagcgattgatcaaaaggcttatttagtctggaaatggttcttagaggtttattctttagatcaggttgctgattataagaaaccaatagatcaaagagctgttttgcaaaatcaagaggataaaatcaaagcacttgaagctaaaattaaagaacttcaagcaaatcgcccacaaaaagttaccgttactcctgaggagcgagtaagacgacatgaaatcaatattcaatttgccaaaaagcataagctaactgaggcagaaacgcgtcaattgattgaccaacaattacgaagtgctggctgggaagttgatactgaacgtcttaataattggaaaaatcaaacacagccacaaaggggtcataatatggcgatcgctgaatgggttctgcccaatgatcaaagagccgattatgctctattcaaaggattagacttctatggtattgtggaagctaaaaaatgggatgaagatattgctggacagatggctcagcctaaagagtatgctaaagaagtgccttatcaatccaattatcatttgctttcaaatcaaatgggagattataaagtaccgtttatttatacggcaaatggtcgtccttatttaaagcagtatcaggagaaatcaggcatttggttctgggatgcaagaaatcctaaagaaaatgcttatgcgcttgaagaatttcataagccagatgacttggcattaaagttaactgctaagaataagacagaagcagataatgatttagttgatgatcatgattatcctaaatttgcggatagaccttatcagattgatgctattaatgcgatggaagatgcaattaaaaatggaaaaaaacgaattctcttggcaatggcaacagggactggtaagactagaaccgctatttcattgatgtatcgtttgttaaagcataagcgtgcacgtcgaatcttgtatttagtagatcgtaattctttaggaagacagactgctaatgcaattaaggataataaaattggaacaatgtcgatttcttcaatctatggattgaaagaattaagtgacaaagttccagatgcttcaaccaagattcaaattgcaacagttcagggatgcaaacgcatccctgtttttgttatactgaagctaaaaatcgtgataggatga

SEQ ID NO: 24 - protein, 492 aa, Lactobacillus acidophilus
MSNFQTSEKNYQEYAKLASSAESLIYSDPRSSVTVFGTFGEQLTKEIMHLDDIVDWELNQKQRIEKLALSRNEYPAVVLTALNEIRFKRNKATHDDQFIATKSDALAIDQKAYLVWKWFLEVYSLDQVADYKKPIDQRAVLQNQEDKIKALEAKIKELQANRPQKVTVTPEERVRRHEINIQFAKKHKLTEAETRQLIDQQLRSAGWEVDTERLNNWKNQTQPQRGHNMAIAEWVLPNDQRADYALFKGLDFYGIVEAKKWDEDIAGQMAQPKEYAKEVPYQSNYHLLSNQMGDYKVPFIYTANGRPYLKQYQEKSGIWFWDARNPKENAYALEEFHKPDDLALKLTAKNKTEADNDLVDDHDYPKFADRPYQIDAINAMEDAIKNGKKRILLAMATGTGKTRTAISLMYRLLKHKRARRILYLVDRNSLGRQTANAIKDNKIGTMSISSIYGLKELSDKVPDASTKIQIATVQGCKRIPVFVILKLKIVIG

SEQ ID NO: 25 - DNA, 2304 bp, Lactobacillus acidophilus
atggatcctgaaaaaatgaatttaacggaggaggatatcaagaacagatatatttcacctgctatttttgaaacagcaggttggaagaaaaaagattctttgatggaatattactacacggatggtcaaatcaatgttgtagatgatgtagccaaacgtggaaacggtaagaaagtagactacttgctcttatacaagcctaactatccaatcgctgtaattgaagcgaaggatagaaagaagcatgcattaccaagtgcagggttgcagcaaggtatggggtatgccagagatttacaagttccatttgcttattcttcaaatggggatgcatttgttgagcatgacatgctgacaggcaaagaaagaaccttaactcttgatgaatttccaactaaagaagggctttggaagagatatgttaaagaaaagaaactatctgataaagagatcaaagcaattaatgaaccatattattcatccagagatacttattcaccacgttattaccaacaaaatgctattaaccgtgtagtagaaaagattgctaatggcgaacgtcgtgccttattagtcatggctactggtacgggtaaaacttacactgcctttcaaattgtctatcgtttattaaaggctgggattaaacatagagtcctttatttagctgaccgtaatattctggttgatcaagcaagattaaatgactttaatccattaagtgacaagataactaaagttcaagatggacatatggatagcgcatatccaattcaattcgctttgtatcaacaattggcgggaaaagatgaagatgttggtcatgaaccatttagacaacttaagcctgacttctttgatttagttgtaatcgatgaagcacaccgtggttctgctaaagctgatagtcaatggcgtaaaattttaaattattttgatggccctaatgtaactcatttaggtatgacggccactcctaagaatgataaagaagcttcgaacatccaatactttggtgatccagtttacacatactcacttaaacaaggtattgaagatggtttcttggcaccatataaggttatcagagttaatttcaatgtggatattaatggcttccgaccatttaaaggcgaaagagataaacatggtcgcgagtttgacaagaagttatatacaacacgtgactttgataaaagtctagtcattgatgaacgtaccgaaatggttgctaaatatgtaagtaaatatatgaaggacaacgatcgacgttgggataaaactattgtcttttgtgaagacattgagcatgctgaaagaatgcgtcaggctttcgtgaatgaaaataccgatttagttgctcaagattcacgttacgttatgagaattactggtgatgataatacaggtaaagcacaattagataactttgaagatgttacaagtaaagttccaacaatagttacaacttctaaattgttgactaccggtgttaacgtaaaaacttgtaaaactattgtgttagattcaaatattaattccatgacagaattcaagcaaatcatcggtcgtggtactcgattagatactgatcatggcaagagctactttacgatcattgatttccgtggagtatcaagattatttgctgatccagcatttgatggtgaaccaattgagataattgatggcaataaaggcacaggctctcataaatcttatcatacaggtgtatctgaaccacctaaacaaaaatatgaagtaagtcataacgtaaaagtttcaaatgcagaaacacaattcttagatgagcatggtaatttaatcactacttctttggttgattacaccaagaaaaacatgcttggtgaatatgctacgttggataatttccttcaagcttggaataaagctgataagaaacaagtgctgcttgatgagatggaaaagcatggcattctctataaggaaatcatcaagcaaaagggtatcagggacatggatccatttgatctcatgattcatcttgcatacaatcaaaaaccactgactaagtcagagagaattaagaatgttaaaaagtcaggtattcttgataaataccaaggtgctgctagggagattcttgatgctttactagaaaaatataaagatgatggaattactgatttggaaagtaataaggtattgagtttacctgaatttgaaaaatacggtggtgccgttaagattattttgacctttggtggtaaaaagaattacgaaaacactattaaagaaattaaagaaaaaatctacagttag

SEQ ID NO: 26 - protein, 767 aa, Lactobacillus acidophilus
MDPEKMNLTEEDIKNRYISPAIFETAGWKKKDSLMEYYYTDGQINVVDDVAKRGNGKKVDYLLLYKPNYPIAVIEAKDRKKHALPSAGLQQGMGYARDLQVPFAYSSNGDAFVEHDMLTGKERTLTLDEFPTKEGLWKRYVKEKKLSDKEIKAINEPYYSSRDTYSPRYYQQNAINRVVEKIANGERRALLVMATGTGKTYTAFQIVYRLLKAGIKHRVLYLADRNILVDQARLNDFNPLSDKITKVQDGHMDSAYPIQFALYQQLAGKDEDVGHEPFRQLKPDFFDLVVIDEAHRGSAKADSQWRKILNYFDGPNVTHLGMTATPKNDKEASNIQYFGDPVYTYSLKQGIEDGFLAPYKVIRVNFNVDINGFRPFKGERDKHGREFDKKLYTTRDFDKSLVIDERTEMVAKYVSKYMKDNDRRWDKTIVFCEDIEHAERMRQAFVNENTDLVAQDSRYVMRITGDDNTGKAQLDNFEDVTSKVPTIVTTSKLLTTGVNVKTCKTIVLDSNINSMTEFKQIIGRGTRLDTDHGKSYFTIIDFRGVSRLFADPAFDGEPIEIIDGNKGTGSHKSYHTGVSEPPKQKYEVSHNVKVSNAETQFLDEHGNLITTSLVDYTKKNMLGEYATLDNFLQAWNKADKKQVLLDEMEKHGILYKEIIKQKGIRDMDPFDLMIHLAYNQKPLTKSERIKNVKKSGILDKYQGAAREILDALLEKYKDDGITDLESNKVLSLPEFEKYGGAVKIILTFGGKKNYENTIKEIKEKIYS

SEQ ID NO: 27 - DNA, 3345 bp, Lactobacillus amylovorus
atgacaaactttgactatcttacaaaggaaaagaaatttaaagacttcgttgatgtagcaatcactgcagaaaaattgattaatgttgatcctgctagttgtattcttgattgtcgtcgagctatggaattcgctattaaatggatgtactcagtggattccgctttggaacgtccatataaagataaactaattagtttaatgagtaccgatgacttccatggtattgtcgatgatgatatgtggagacaattagacttaattagacgattaggtaatattgctgcacactctcgtagaaaaattgaacgagatcaagctgttttatgcttgaagaatctacataactttttggattttattgactactgttatgcagatcattatgaatctaagccatttgatgaaaagttattagatcaaactcctactctagtttcatcagaacctgccaaagttcaaattagtttggacagtttagttaagaaaaataaacatgttcaggaaaaattatcaattcgtggtgaagctcaaagaaaagaaaaagagaagaaaaaggctcaaccacctaagcatccatttagtttatccgaattcaagactcgaaagatatacatcgatactctcttaatggatgctgactggacagaaggtaaagattggattaatgaattcaaattagagggtatgcctaatgtctcagaagtaggctatgcagattatgttcttctagataatactggcatccctcaagttgtcattgaagctaagaaaacttgtgttgatgtgtcagtaggccgtcaacaagctaagctttatgctgacttagtagaacaaaaatatggtagaagaccatacgtcttcttaactaatggttttgaaacaaggttcatcgataatgaacacccagagcgaaaagttgcagggttctattcgaaacgtgacttagagaaattacgtaatctgcagaacatgagacaaaggcatcttgataatattcaaatcgatgaaaatatcgcaggacgttattatcaaaaggctgctattaaggctgtatgtgaaagtttcgataaaggaaagaaacgaaaagctttgttagttatggctactggttctggaaaaactagagtatcagttgctcttagcaaggtattgcttgatgcaggttgggttaagaatattcttttcttggcagacagaactgctttagttacgcaggctaaaagaagttttgtcaacttattgccagacttaacttgtactgatttgaccaaaaagggtaagaacctcaatgcaagatgcgtcttttctacttatcaaactatgatgggctgcattgattctcttagagatgatgaaggaaaattatttactattggtcactttgatttgattattgtagatgaggcacaccgttcaatttacaacaagtatcgtgatatctttaattattttgatgcgccaatagttggtcttactgcaactcccaaagatgagattgataaaaatacttattcagtattcgatttggaagatggcgttccaacatatggctatgaattagctgatgctgttaaagatggatacctggtaaattatgtttcaattgaaactaaattaaaattcttggatcaaggtattaaatatgatgatttatctgaagaggataaggaatcatatgaagatacatttgaagatgaaaatggtgagctgccgaaacaaatcaatcctacggctattaataattggattttcaatgaggatacaatcaaaaaagtcttacacacagtgatggataaggcattgaaagttaactatggtgaagaaataggaaagactataatctttgcacaaaatcataggcatgctgaagagatcttgcgtatctttaatcaagaatatcctaatttagctgatggtaaggatggtcgtccttacgctgaggttattgataattatattaattatgctcagactgccattgacgaattttcagaaaccgataagatgcctagaattgctatttctgttgatatgcttgatacaggaatagatgtaccatcatgtttgaatctagtgttctttaagaaggtttatagtaaatcaaagttttggcaaatgattggtcgaggtacacgtttgtgtcctggattaatggatggcaaagataaggataagttctacatctttgatttctgtagcaactttgaattctttagaatgggccatggtagagaagctaaagccactttgccacttcaaggtgctttgtttaacttagagtttcagttggtctacaagttgcaagatgtaaattatcaaactaatcctatgatcgagtatcgaaacagactgattaagaacctgctcagaaaggtaaatgaattaaaccgtgataattttgcagtaagacagcatattaaagaagttgatgaatatgccaatgcagtaaattataaagatcttacttatgatgattgtttagaagtacgtgaagaattatcaccattgattttacctgacgaggatgatatctcagcattaaggtttgacgcagtagttcttgaattggaattagccaatatttctgagaaaccagcgaatagatataaaactgatattattaaaaaggtcactgctatctctaaagtgacaaatataccagaaattgccacacaaaaggatttgattcaaagaattattgaaactgattatctgaatagagcagggattgaagatttagagcatattcggaaatcattacgtgatctgatcaagtatattcctaaaaagtcactgatatttgatactgactttaatgatgaaatattagatacaaaagttaatgaagccgaatataatactgatactttgaagaattataaagccaaagttgaatattatataaataagcatcaaaaggataatgaagtcatagttaagttaaagagtaataagcctttaactgaaggagacttgaagaatttggagaaagtattttggaaagatattggtactaaggacgattacacaaaagagtatggtgatcaacctttgggtgaatttatccgtagtattgtcgggctggatatgaattcagctaaggaagctttctcaaaatatttgaatgataagtcattgaattcacgacaaatttatttcttgaatcaagttatcgagtatattgttaaaaatggaatgatgagagatctttctgttttgcaagactcaccttttacggatcaagggaatattattgatttgtttggtgataataaatcattgtggttaggtattaaggaagttattgatagtattaatcataatgctagtgttgtagcttaa

SEQ ID NO: 28 - protein, 1114 aa, Lactobacillus amylovorus
MTNFDYLTKEKKFKDFVDVAITAEKLINVDPASCILDCRRAMEFAIKWMYSVDSALERPYKDKLISLMSTDDFHGIVDDDMWRQLDLIRRLGNIAAHSRRKIERDQAVLCLKNLHNFLDFIDYCYADHYESKPFDEKLLDQTPTLVSSEPAKVQISLDSLVKKNKHVQEKLSIRGEAQRKEKEKKKAQPPKHPFSLSEFKTRKIYIDTLLMDADWTEGKDWINEFKLEGMPNVSEVGYADYVLLDNTGIPQVVIEAKKTCVDVSVGRQQAKLYADLVEQKYGRRPYVFLTNGFETRFIDNEHPERKVAGFYSKRDLEKLRNLQNMRQRHLDNIQIDENIAGRYYQKAAIKAVCESFDKGKKRKALLVMATGSGKTRVSVALSKVLLDAGWVKNILFLADRTALVTQAKRSFVNLLPDLTCTDLTKKGKNLNARCVFSTYQTMMGCIDSLRDDEGKLFTIGHFDLIIVDEAHRSIYNKYRDIFNYFDAPIVGLTATPKDEIDKNTYSVFDLEDGVPTYGYELADAVKDGYLVNYVSIETKLKFLDQGIKYDDLSEEDKESYEDTFEDENGELPKQINPTAINNWIFNEDTIKKVLHTVMDKALKVNYGEEIGKTIIFAQNHRHAEEILRIFNQEYPNLADGKDGRPYAEVIDNYINYAQTAIDEFSETDKMPRIAISVDMLDTGIDVPSCLNLVFFKKVYSKSKFWQMIGRGTRLCPGLMDGKDKDKFYIFDFCSNFEFFRMGHGREAKATLPLQGALFNLEFQLVYKLQDVNYQTNPMIEYRNRLIKNLLRKVNELNRDNFAVRQHIKEVDEYANAVNYKDLTYDDCLEVREELSPLILPDEDDISALRFDAVVLELELANISEKPANRYKTDIIKKVTAISKVTNIPEIATQKDLIQRIIETDYLNRAGIEDLEHIRKSLRDLIKYIPKKSLIFDTDFNDEILDTKVNEAEYNTDTLKNYKAKVEYYINKHQKDNEVIVKLKSNKPLTEGDLKNLEKVFWKDIGTKDDYTKEYGDQPLGEFIRSIVGLDMNSAKEAFSKYLNDKSLNSRQIYFLNQVIEYIVKNGMMRDLSVLQDSPFTDQGNIIDLFGDNKSLWLGIKEVIDSINHNASVVA

SEQ ID NO: 29 - DNA, 2988 bp, Lactobacillus amylovorus
atgagaggctcgattaacgaacgctatgaatatcaacaatacatcattgatcaattaaaaaatgatggctaccttgaaagggatgctgacgactttgaccgtctacatgcaatggatcatgaattgctactaaaatttttaaaagcaactcaacctaaagaatttgcatccctcaagaagatgtatggtgatgatttaccagattttattgtcaacagtgtaaacaaagctgctaccgataaaaatggtagcatgttagatctacttaaacacggaattgatattgccaaccatcacttaactttgttctacaacaagccagctactgactttaatcctgacttgattaagaaatatcaaaataatatcttttccgtaatgcaagaggtctgggctactgacgatgagcgagtagatttagtcatttttatcaatggaattgctattatcagttttgaacttaaaagtaacactcaacatcaagactatcatgatgctataacacaataccggaaagatcgcgatcctaaagcaagacttttcttattcaaagctggttgtttagttaactttgcaatggacttgaacgaagtctacatgactaccaaacttgaaggtaataaaacttacttcatgccctttaaccaaggaaaaggtagtggggtagattcaggtgcaggtaacccagtaaataaaaatggtgaattcagtgtcagctacatgtggaatgatatcttaactaaagatactttaactgaattaattgaaaagtttatcttcattgaaaccaaagagaagaccaatgaactaactaataagacaaaaacagtacaacgacttatctttccacgatatcaccaattagatgccattcgtaaaattcttgctgacttaaaaattaatcatacgagtcaaaattaccttattgagcactctgctggatcaggaaagaccaataccattgcttggctagctagcagattgacttcactacatgataacgaaaacaatcaaatcttcgataacattataatcatgactgaccgtgtggtagtcgaccgacaattacagcaagcaatgaaacgaattgatattgctgacggtgtgattcaaacaatggacgatagttgtaattctgcagacttggaaagagcattagcaggtaataccaaggtcattgttacaacaattcaaaaatttccatatgttcttaatattattaaagacgcgggcaagaatggtcctaacttaaagaataaaaaattcgctgtaattattgatgaagctcattcatcaacagcgggcaagaacatgatggctgtaactcaaactttatctgctgatgaagagaaagaagatcttgacttacaggatatattaactcaagaaattaaaagttctggtaaacaacctaacgtcagcatgtttgcttttactgctacacctaaatcgacaactttaagattattcggtcgacctgataaatatggtgactatagggcttttcacttatacagcatgaaacaggcaattgaagaaggatttattcttgacgtattatctcactacattacttataaaaccttttataagctaaataagaacgtcaaagaggatcctaatttaaacactgcagatgctaagcgccaaatcaataattttattgacctaaatgatccaaatattcagcaacgcactcagatcatcatcgaacattttaaaaatcatgttgctaaagaattaaaaggtaatgccaaagcaatggtaatcacttcttctcgaaaagcagcagttaagtatcaatttgcctttgagcaatatattaaagagcacggatatgatgatataaaggctctggttgccttttctggctcagtcaagttagataataaagaatatactgaagcctctataaatggcttctctgagggtagaacgccaaaagcatttaacacaccaaattacaatgtactaattgttgcgaataaataccaggttggttttgatcaaccgaaattaacagcaatgtatgttatcaagaagttaagaggggttaatgctgttcaaacactatctcgcttaaatcgtgtctgtccaccctacgataagacacccgttgtacttgactttgctaatgactataaggatatagaagaggcttttcagccatactacactactacgttactagctaatacggttaatccatctacaattcataatcttgatgaaaagattgatggttactacatcattcgtcccttagatgtagatgatgttaataaattaattcataagaaaaatattaattttagagataagcaaaacctaaacttttactttgcaaaaactcaagaagaagtaaataaattagacgcacctgatcaagtggaatttttaaaattattgagacacttttgtcgttattatgaatttctactacaagtttctagcttagaagatactgaattacaaaagaaatacaactatatctcatatctactgaaatacatcaatatcagtaatccaggggatggatatgacttaacgggtaagttgaaggctgacaacttcattcaaaagaaatctggagatcacgagaagaagaaacacaagtcaaatccagtcttaaatttaccaaatgcagaagatattaattttagtgaaccaactaagaaaaagctttctgagattattaaagaaattaacaatagaactggttctaacttcgactctgatgtgacaaccaaatctctgctacaaattaaagacatcatgatgaaagatccacatctaaaagaaagtgctaaaaacaatacagaacaagactttgaattggcatactttgataaagtagataacgcattgattgagggcataagtcaaaacaaagacttctttacgtatttgcttaacactcctgaaatcagaaaagatgtcatgggaatctttgctcaagaaatctataaagctttgaggaaagaataa

SEQ ID NO: 30 - protein, 995 aa, Lactobacillus amylovorus
MRGSINERYEYQQYIIDQLKNDGYLERDADDFDRLHAMDHELLLKFLKATQPKEFASLKKMYGDDLPDFIVNSVNKAATDKNGSMLDLLKHGIDIANHHLTLFYNKPATDFNPDLIKKYQNNIFSVMQEVWATDDERVDLVIFINGIAIISFELKSNTQHQDYHDAITQYRKDRDPKARLFLFKAGCLVNFAMDLNEVYMTTKLEGNKTYFMPFNQGKGSGVDSGAGNPVNKNGEFSVSYMWNDILTKDTLTELIEKFIFIETKEKTNELTNKTKTVQRLIFPRYHQLDAIRKILADLKINHTSQNYLIEHSAGSGKTNTIAWLASRLTSLHDNENNQIFDNIIIMTDRVVVDRQLQQAMKRIDIADGVIQTMDDSCNSADLERALAGNTKVIVTTIQKFPYVLNIIKDAGKNGPNLKNKKFAVIIDEAHSSTAGKNMMAVTQTLSADEEKEDLDLQDILTQEIKSSGKQPNVSMFAFTATPKSTTLRLFGRPDKYGDYRAFHLYSMKQAIEEGFILDVLSHYITYKTFYKLNKNVKEDPNLNTADAKRQINNFIDLNDPNIQQRTQIIIEHFKNHVAKELKGNAKAMVITSSRKAAVKYQFAFEQYIKEHGYDDIKALVAFSGSVKLDNKEYTEASINGFSEGRTPKAFNTPNYNVLIVANKYQVGFDQPKLTAMYVIKKLRGVNAVQTLSRLNRVCPPYDKTPVVLDFANDYKDIEEAFQPYYTTTLLANTVNPSTIHNLDEKIDGYYIIRPLDVDDVNKLIHKKNINFRDKQNLNFYFAKTQEEVNKLDAPDQVEFLKLLRHFCRYYEFLLQVSSLEDTELQKKYNYISYLLKYINISNPGDGYDLTGKLKADNFIQKKSGDHEKKKHKSNPVLNLPNAEDINFSEPTKKKLSEIIKEINNRTGSNFDSDVTTKSLLQIKDIMMKDPHLKESAKNNTEQDFELAYFDKVDNALIEGISQNKDFFTYLLNTPEIRKDVMGIFAQEIYKALRKE

SEQ ID NO: 31 - DNA, 3027 bp, Lactobacillus amylovorus
gtgcaacaagaatctgtaattgaagacaatttaatccaacaacttatacatggtaaatctcagtggacactccgtgaagatttaaaggatgaagatgatctttgggataatttctttaaaatcctaacaacccataatctgaatcctttaaaagatgtgccattgactgacaatgaaaaagcggttatcaagtcaaagattgttcaaccaactttctataaagcagctgaatggcttgccggtgctaatggggaagtcagagtacaactacaaagagataatactaagttaggtattgctgatttattagtattgaacaacaacgaaattgccggtggtaattcagtatatgaagtagttcatcaaattcaattccacaagcgtagagatattgatcgtaatcgtcgtactgacgtaactttgctgattaatggcttacctatgattcatattgaattgaagaatagggcacattctactaaagaagcattcaatcaaattcaaaagtacattgatgagcaaatgttcaatggtatttactcaactattcaaatgtttgttgtttcaaatggtacttacacgcaatacatagcagcaggacaacaattaagagaaaagttcttaactaactgggtggatgagaataataagccagttcaaaactatcttgactttgctagggatgtattatcaattccacaagctcaccacatgattgctgattatattgttttagacagtattcaacacaacattattgtgcttcgtccttatcagattcacgcaattcaagctatcgaaagagcttcagcagggttgaaagatgatgataaatgggattcagcttattcaggttttgtctggcacactactggttcaggtaaaactttaacctcatataaagtagctcacaacttactcaagattccgtcaattgaaaagacagttttcttaattgatcgtaatgatttggatactcagacttcacaagcttttgaaacttatgctcaaaatgattctattaatgttgaaccaacagagaacagttatgttttggcaagaaagttaacaagtggtgataagaaggtaatcgttactactcgtcaaaagatgcaagctttattcaaacgaatccaagaagataaagaacaaaaactgctatatagaaaactaaaaaatgttaaattggcctttatcgttgatgaatgtcaccgtgcagtttcacctgatcaaaagaatgaaatagatgcattctttgctaagcatcccctttggtacggcttcacaggaacaccaatttttgctgaaaatgccagagaagccaagggtaggaatgcacgtactaccgaacaacaatatggtaagtgtcttcacaaatacactattaaagatgccattagagacaaagccgtcttaggtttccaagtggaagagactaagaattattcagaggatactgatgaatcagatactgcagcgagaaataaagagtatctttcaacttcacatatgaaggccgtagttaagcgagttttatctgattcataccgcaaactcggtatttataacaaagaacgtcgtggctacagttatgatgctatttttaccactagttcaattaagcaagctcagaagtattaccgcattttcagggatgtaattaatggtgaagatgacgacataaaagttcctgagcgaatcaaacgcattatgccagatttccctaagattgctattacttattcaatcggtgaaaacggtgatggcgatgaggccaatcaaaatgagatgagacagtcacttgatgactacaacaagatgtttggtactagttactcaatgtctgaactcgctgcttataataccaatgttaatgatcgtttagctcgtaagaagaaagagttccaaccacgttcacaacagttagatatcgtaattgttgttgatcgactcttaactggctttgatgctccaactttgtcaacattgtttattgatcgtccacctatgccatataaagatttgattcaagcattttctagaactaacagaatcttcgataaagataagagatatggtcaaattgttacttaccagtatcctgaaaaatacaaggatagtatcaatgctgccctgatgttatacacagaaggtgggaatgatacagttcttgctccgacttggcatgaatcagttgttaaatttcagaatgctgaaaagaagatcatcaaatacaagggcgatcagggtatgccaatcactgaagcaccaattgagcaacaaaaacaattcttgaaggaatatcaagactttgataagacattgggtgctgtaaagacatataacgaattcagcgacagtgatcttgaagataagtatggtcttgatgatatgttcattgaggatcttcatgctgcttatgaagtagtcaaagataatgtgaagactgctgaaggtggcaatgatggtgaagatgacgatgatagttatgatccagattatgagttggaaaatgctggttctcaagaaatcaattacgcttatatcgttcaattaattcaggcatacattccttcggatgatgaggatgagtctcagagaactgaagctgaaaagaaagagattgatgattacattgagaatctagctaagacgaataatactcttgctaagattatgaacgatctttggttccaaattaagatggatcctgagaagtttagaaataagcaagttaatgaactgctgcaagaaatgatagatgatgctcgtgaagacatgcttaagaagtttgccaaggataatggattgaatcttgatgatcttaaatttgtgattcgtaattatgatccagacgcagacaagcgccagcaggctggtattaatactttgctctcgtttaaagtgtttagcgagtatagaaagactcatccagatatcaatatgttaacttggaagaaaaatgttcgttcaggacttaaagacttttatatgaatcagatttctcctttggataatagggaatag

SEQ ID NO: 32 - protein, 1008 aa, Lactobacillus amylovorus
MQQESVIEDNLIQQLIHGKSQWTLREDLKDEDDLWDNFFKILTTHNLNPLKDVPLTDNEKAVIKSKIVQPTFYKAAEWLAGANGEVRVQLQRDNTKLGIADLLVLNNNEIAGGNSVYEVVHQIQFHKRRDIDRNRRTDVTLLINGLPMIHIELKNRAHSTKEAFNQIQKYIDEQMFNGIYSTIQMFVVSNGTYTQYIAAGQQLREKFLTNWVDENNKPVQNYLDFARDVLSIPQAHHMIADYIVLDSIQHNIIVLRPYQIHAIQAIERASAGLKDDDKWDSAYSGFVWHTTGSGKTLTSYKVAHNLLKIPSIEKTVFLIDRNDLDTQTSQAFETYAQNDSINVEPTENSYVLARKLTSGDKKVIVTTRQKMQALFKRIQEDKEQKLLYRKLKNVKLAFIVDECHRAVSPDQKNEIDAFFAKHPLWYGFTGTPIFAENAREAKGRNARTTEQQYGKCLHKYTIKDAIRDKAVLGFQVEETKNYSEDTDESDTAARNKEYLSTSHMKAVVKRVLSDSYRKLGIYNKERRGYSYDAIFTTSSIKQAQKYYRIFRDVINGEDDDIKVPERIKRIMPDFPKIAITYSIGENGDGDEANQNEMRQSLDDYNKMFGTSYSMSELAAYNTNVNDRLARKKKEFQPRSQQLDIVIVVDRLLTGFDAPTLSTLFIDRPPMPYKDLIQAFSRTNRIFDKDKRYGQIVTYQYPEKYKDSINAALMLYTEGGNDTVLAPTWHESVVKFQNAEKKIIKYKGDQGMPITEAPIEQQKQFLKEYQDFDKTLGAVKTYNEFSDSDLEDKYGLDDMFIEDLHAAYEVVKDNVKTAEGGNDGEDDDDSYDPDYELENAGSQEINYAYIVQLIQAYIPSDDEDESQRTEAEKKEIDDYIENLAKTNNTLAKIMNDLWFQIKMDPEKFRNKQVNELLQEMIDDAREDMLKKFAKDNGLNLDDLKFVIRNYDPDADKRQQAGINTLLSFKVFSEYRKTHPDINMLTWKKNVRSGLKDFYMNQISPLDNRE

SEQ ID NO: 33 - DNA, 3336 bp, Lactobacillus amylovorus
atgacaaactttgattaccttacgaaggaaaagaaatttaaagattttgttgatgtagcaatcactgcagaaaaattgattaatattgaccccgctagttgtattcttgattgtcgtcgggctatggaatttgcaattaaatggatgtactcagttgattctgctttagaacgtccatatcaagacaaacttattagtttaatgagcactgacgatttccacggcattgttgatgacgatatgtggagacagttggacttaatcagacgattaggtaatattgctgcgcattctcgtagaaaaattgaacgagatcaagctgttttatgtttaaagaatctacataacttttttgattttattgattactgttatgcagatcattatgaatcaaagccatttgatgaaaaattattagatcaaactcctactttagtttcttcagaacctgccaaaattcaaattagtttggacagcttagttaagaaaaacaagcatgttcaagaaaaattatcaattcgtggtaaagttcaaagaaaagaaaaagaggagaacaaaactcagcccccatttagtttatccgagtttaagactcgaaagatatatatcgatactttgttaatggatgctgattggacagaaggcaaggactggattaacgagtttaaactggaggggatgcccaatactgcaggtgtaggctatgcagattatgtacttttagataatactggtatccctcaagcagttattgaggccaagaaaacttgtgttgatgtgtcagtaggccgtcaacaagctaaactttatgctgacttgatagcacaaaaatatggtagaagaccatatgtattcttatctaacggctttgaaacaagattcatcgataatgagcacccagaacgaaaagttgcaggtttctattcaaaacgtgatttagaaaaattacgtaatttgcagaatatgagacaaaagcatcttgataatattcatgttgatgagaatattgcaggacgttattatcaaaaggctgctattaaggctgtatgtgaaagtttcgataaaggtaagaaacgaaaagctttattagttatggctactggttctggaaaaactagagtatcagttgctcttagcaaggtactgcttgatgcaggttgggttaagaatattctatttttagctgatagaactgctttggttacccaggctaaaagaagttttgttaacttattgccagatttaacttgtacagatttgaccaagaagggtaagaatctcaatgcaagatgcgtcttttcaacttatcaaactatgatgggatgcattgattctcttagagatgacgaaggaaaattatttactattggtcactttgatttaattattgtggatgaagcacaccgctcaatttacaataaatatcgcgatatctttaactattttgacgcgccaatagttggtcttactgcaactcctaaagatgaaattgataaaaatacttactcagtgtttgacttggaagatggtgtcccaacatatggctatgaattagctgatgctgttaaagatggttatttggtaaactatgtttcaattgaaactaagctgaaattcttagatcaaggtattaagtatgatgatttgtctgaacaggataaggaatcatatgaagatacttttgaagatgaaaatggtgagctgccaaaacaaatcaatcctacagctattaataattggatttttaatgaagatacaatcaaaaaagtcttacatacagtaatggataaagcattaaaggttaactatggtgaagaaataggaaagaccataatttttgcgcaaaaccatagacatgctgaagaaatcttacgtatctttaatcaagaatatcctaatttagttgatggtaaagatggtcgtccttacgctgaagttattgataattatattaattatgctcaaacagccattgatgaattctcagaagctgataagatgcctagaattgctatttctgtcgatatgcttgatacaggtatagatgtaccgtcatgcttgaacttagtattctttaagaaggtttatagtaaatcaaagttctggcaaatgattggacgaggtacacgtttgtgtcctggattaatggatggcaaagataaggataaattctacatctttgatttctgtagcaactttgaattctttagaatgggtcatggtagagaagctaaatctactttgccactgcaaggtgctctgtttaatttggaattccaactagtctataagttgcaagatataaattatcagactaatcctatgatcgagtatcgaaataggctgattaaaaacttgataaagaaggtaaatgaattaaatcgtgataattttgcagtaagacagcatatcaaagaagttgatgaatatgcaaatgcagtaaattataaagatcttacttatgatgattgtttagaggtgcgtgaagaattatcaccattgattttacctgatgaggatgatatctcggcactaaggtttgatgcagtggtacttgaattagaattagctaatatttctgaaaaaccggccaataggtataagactgatatcattaagaaagttaccgctatttctaaggtagccaatataccagaaattgctgcacaaaaagatttgattcaaaggattattgaaaccgattatctgaacagagcgggaattgaagatctagagcatgttcgaaaagcattacgtgatctgattaagtatattcctaaaaagtcattaatatttgatacagactttaatgatgaaatactggatactaaggttaataaggccgaatataatacagatactctgaaaaattataaagctaaagttgaatattatataaataagcaccaaaaggataatgaagtcatagttaaattaaagagtaataaacctttaactgaaggtgacttgaagaacttagagaaagtattttggaaagatattggtactaaggatgattacacgaaagagtatggtaaccaacctttaggtgaatttattcgtagtattgttggcctggatatgaattcagctaaggaagccttctcaaagtatttaaatgataaatcattgaattcaagacaaatatactttttaaatcaggttattgagtatattgtcaaaaacggaatgatgaaggatctttctgttttgcaagactcaccatttactgatcaggggaatattattgatttgtttggtgataataaatcattgtggctaggcattaaagaagttattgatagtattaatcataatgctagtgttgtagcttaa

SEQ ID NO: 34 - protein, 1111 aa, Lactobacillus amylovorus
MTNFDYLTKEKKFKDFVDVAITAEKLINIDPASCILDCRRAMEFAIKWMYSVDSALERPYQDKLISLMSTDDFHGIVDDDMWRQLDLIRRLGNIAAHSRRKIERDQAVLCLKNLHNFFDFIDYCYADHYESKPFDEKLLDQTPTLVSSEPAKIQISLDSLVKKNKHVQEKLSIRGKVQRKEKEENKTQPPFSLSEFKTRKIYIDTLLMDADWTEGKDWINEFKLEGMPNTAGVGYADYVLLDNTGIPQAVIEAKKTCVDVSVGRQQAKLYADLIAQKYGRRPYVFLSNGFETRFIDNEHPERKVAGFYSKRDLEKLRNLQNMRQKHLDNIHVDENIAGRYYQKAAIKAVCESFDKGKKRKALLVMATGSGKTRVSVALSKVLLDAGWVKNILFLADRTALVTQAKRSFVNLLPDLTCTDLTKKGKNLNARCVFSTYQTMMGCIDSLRDDEGKLFTIGHFDLIIVDEAHRSIYNKYRDIFNYFDAPIVGLTATPKDEIDKNTYSVFDLEDGVPTYGYELADAVKDGYLVNYVSIETKLKFLDQGIKYDDLSEQDKESYEDTFEDENGELPKQINPTAINNWIFNEDTIKKVLHTVMDKALKVNYGEEIGKTIIFAQNHRHAEEILRIFNQEYPNLVDGKDGRPYAEVIDNYINYAQTAIDEFSEADKMPRIAISVDMLDTGIDVPSCLNLVFFKKVYSKSKFWQMIGRGTRLCPGLMDGKDKDKFYIFDFCSNFEFFRMGHGREAKSTLPLQGALFNLEFQLVYKLQDINYQTNPMIEYRNRLIKNLIKKVNELNRDNFAVRQHIKEVDEYANAVNYKDLTYDDCLEVREELSPLILPDEDDISALRFDAVVLELELANISEKPANRYKTDIIKKVTAISKVANIPEIAAQKDLIQRIIETDYLNRAGIEDLEHVRKALRDLIKYIPKKSLIFDTDFNDEILDTKVNKAEYNTDTLKNYKAKVEYYINKHQKDNEVIVKLKSNKPLTEGDLKNLEKVFWKDIGTKDDYTKEYGNQPLGEFIRSIVGLDMNSAKEAFSKYLNDKSLNSRQIYFLNQVIEYIVKNGMMKDLSVLQDSPFTDQGNIIDLFGDNKSLWLGIKEVIDSINHNASVVA

SEQ ID NO: 35 - DNA, 3051 bp, Lactobacillus casei
atgggtgcaacacttgaatctacgtttgaaaaacgattaatcgaacagttgacgaggggcatttcacaatggacgtatcgtccggagctaaagacagaggaggatttgtggcgtaactttcggcagaaaatcgaacaaaataatgttgctgtgttggacggacatccgctaacagaacaagagtttcgtcaaattcagaatcagcttcaatttggtacgttttatgatgccgctaagtggttggctggcgaaaatggtgtggccaaagttcaagtgcaacgtgaagatgccacgctaggaacggttcgactagaagttgttcgtcgggaagatgtagctggtggtacttcttcctacgaggttgttaatcagatcgaaatgcccaaagtgtttgctgactaccagaatcgtcggtttgatgtctcacttttgatcaatgggttaccgttaattcatatcgaactcaagaatgctgatcactcttatatggatgcttttcgtcaaattaaaaaatatctgagtgacggtatgtttaatggcatctattcagttgttcaaatgttcgttgtcagtgacccgtaccacacacgttatattgcgccggcttcaggcaccaagatgaacgagcgcttcttaaccaactgggtcgatgagcataatcaacctgtagagacgcttactgattttacggatcaggtactttcaattccacaagcacataaaatggtgactcagtataccgtgattgattcgattcgaaagtccttaattttgctgcggccttatcagattcatgcgattgagcgagttcgtgaggcgacaaaacaccaagtgtccggatacgtctggcataccacaggctcaggaaaaacgcttacagcatacaaagtagctcgaaatcttttacaaattcccagtattgataaaactatctttattgtggatcgagtcgacctagaccagcaaactacaagttcttttatggcttacgctgaaaacgatacgattgatattgatgagactgaacacgttcgcgatcttattaagaaactaaaaagtacagaccgcactgtcattgtcacgacgattcaaaaacttaactttgtcatgcgtcggtttgcggataagcaaggcacacgagactatgagcgattgacaaagttaaagattgcttttgttgttgacgagtgtcatcgcgctgttacttcgcgaaaacagtgggaaattaacggctttttccatcacgcgttgtggtatggctttacgggtactcccatatttgagcagaatgcacgtaaagaagagggaaacttgccccgaacgactgcggaacaatatggcgaacgactgcatgagtatacagtcaaagaagcaattcatgatggtgccgtcttgggctttcaagtggagtatataaatacgattcgtgatgatcaactaactgagttaattgcgaagcgcacaggagagtcccttgcagacgtggcaaagatggatcctgttgagatggaaaagaacctgctctcttctgattatttgaacaaaaatcatatgtggaaagtgatagaggggatcgtcaaccattcacaaaagaagctgggcttgtacaatggccgaggcaattcttacacggctttgttgacaactagttccatttcgcaagcacaaaaatattatgaattgttcaaagagttacgtgctggtaaagcgccatttacaatgaacaagcgtacctcagaattattacctgactttccgaaagttgctatcacttattcagtcactgaaaatgacctcgattcaaccctgaatcaagacgcgatgcgaaagtccattcgtgactataacgagatgtttggtacgagttacagtcttgagaatattaacttatataatgctaatagcaatgatcggttagctcgtaaacaggcccgttacctgtctcgtgaggagcaattagacctcgttattgtggttgatcgattattgactggttttgatgcgccgtgcttgtctaccttgtttattgatcgcaagccgatgcagctgcaaaatatcattcaagctttttctcgaaccaatcgtatctttgacaaaaataaacagtatggacagattgttgtctatcaactgccgaatacctttgcaaaagcagtcgaagatgcgttaatcctctattcaaatggcggtgaaaatgaagtccttgcccctgagtggaaggtagcgcacaaccgattaaagaaggcagcttcaagcttgaaaaagttcaagattgatccttctggtccacctatcagtgaattaccagatgcaaccttgaagcaatttgccaaggcatttcaaggctttgataagggactggctgctgcgcaggtttatagcgaatatgactcagacgaaattcaagatgagattgctatcgattctcaagacatcgaggaatacacaagtgcctataacaatgttattgacgaattaaagcggcgtcgacaaactgaagggcctgaagaagacgatttagatattgagtatgagttggaaaccgtacgtcaggacacgatcaactacgagtatattgttaacctcatccaagcctatgtcagcgactctcgcgatgacaagcctgccgttagccaaaaacgggtggaagaaatttcgaattacgttgatagattaaaaaacaacaacgaaaaactaggctccttgatggaaagcctatggcgtaagattcaagctaatcctaaagaatttcaaaatcagaatgtccaaactttgctccagacaatgaaaaacgaaacaatcgaacatttggtcaaggatgtcgcgacgacatggggtgccgatcctgaagaggcgcttttctacgctgagaattttgatccgaagaaggaatctaatcccggcgaagagagtttgaagcgtcatatggattatgaaatgtataaggaaaatagtgaaaatcctgtcaaaaagatctcgtactggcgcgaatttaaagatgcgtactcgaatctcattcgcgaagagatcttgccacttaatcaggactaa

SEQ ID NO: 36 - protein, 1016 aa, Lactobacillus casei
MGATLESTFEKRLIEQLTRGISQWTYRPELKTEEDLWRNFRQKIEQNNVAVLDGHPLTEQEFRQIQNQLQFGTFYDAAKWLAGENGVAKVQVQREDATLGTVRLEVVRREDVAGGTSSYEVVNQIEMPKVFADYQNRRFDVSLLINGLPLIHIELKNADHSYMDAFRQIKKYLSDGMFNGIYSVVQMFVVSDPYHTRYIAPASGTKMNERFLTNWVDEHNQPVETLTDFTDQVLSIPQAHKMVTQYTVIDSIRKSLILLRPYQIHAIERVREATKHQVSGYVWHTTGSGKTLTAYKVARNLLQIPSIDKTIFIVDRVDLDQQTTSSFMAYAENDTIDIDETEHVRDLIKKLKSTDRTVIVTTIQKLNFVMRRFADKQGTRDYERLTKLKIAFVVDECHRAVTSRKQWEINGFFHHALWYGFTGTPIFEQNARKEEGNLPRTTAEQYGERLHEYTVKEAIHDGAVLGFQVEYINTIRDDQLTELIAKRTGESLADVAKMDPVEMEKNLLSSDYLNKNHMWKVIEGIVNHSQKKLGLYNGRGNSYTALLTTSSISQAQKYYELFKELRAGKAPFTMNKRTSELLPDFPKVAITYSVTENDLDSTLNQDAMRKSIRDYNEMFGTSYSLENINLYNANSNDRLARKQARYLSREEQLDLVIVVDRLLTGFDAPCLSTLFIDRKPMQLQNIIQAFSRTNRIFDKNKQYGQIVVYQLPNTFAKAVEDALILYSNGGENEVLAPEWKVAHNRLKKAASSLKKFKIDPSGPPISELPDATLKQFAKAFQGFDKGLAAAQVYSEYDSDEIQDEIAIDSQDIEEYTSAYNNVIDELKRRRQTEGPEEDDLDIEYELETVRQDTINYEYIVNLIQAYVSDSRDDKPAVSQKRVEEISNYVDRLKNNNEKLGSLMESLWRKIQANPKEFQNQNVQTLLQTMKNETIEHLVKDVATTWGADPEEALFYAENFDPKKESNPGEESLKRHMDYEMYKENSENPVKKISYWREFKDAYSNLIREEILPLNQD

SEQ ID NO: 37 - DNA, 3051 bp, Lactobacillus casei
atgggtgcaacacttgaatctacatttgaaaagcgattaattgaacagttgacgaggggaatttcgcaatggacgtatcgtcaggatctaaagacagaggaggatttgtggcgtaattttcggcaaaagatcgagcaaaataatgttgctgtgttggacggacatcctctgacagaacaagaatttcgtcaaattcagaatcagcttcaatttggtacgttttatgatgccgctaagtggttggctggcgaaaatggtgtggccaaagttcaagtgcaacgtgaagatgccacgctgggaacagttcgactagaagttgttcgtcgggaagatgtagctggtggtacttcttcctacgaggttgttaatcagatcgaaatgcccaaagtgtttgctgactatcagaatcgtcggtttgatgtttcacttttgatcaatggactaccgttaattcatatcgaactcaagaatgcggatcattcatacatggatgcttttcgtcagataaaaaagtatctgagtgacggtatgtttaacggcatctattcagttgttcaaatgttcgttgtcagtgacccgtaccacacacgttatattgcgccggcttcaggcaccaagatgaacgagcgcttcttaaccaactgggtcgatgagcataatcaacctgtagagacgctgactgattttacagatcaggtactctcgattccacaagcacataaaatggtgactcagtataccgtgattgattcgattcgaaagtccttaattttgttgcggccttatcagattcatgcgattgagcgggttcgtgaggcgacaaaacaccaagtgtccggatacgtctggcataccacaggttcagggaaaacgcttacagcgtacaaagtagctcgaaatcttttacaaattcccagtattgataaaactatctttattgtggatcgagtcgacctagaccagcaaactacaagctctttcatggcttacgctgaaaacgatactattgatattgatgagactgaacacgttcgcgatcttattaagaagctaaaaagtacagaccgcactgtcattgtcacaacgattcaaaagcttaactttgtcatgcgccggtttgcggataaacaaggcacacgagattatgagcgattgacaaagttaaagattgcttttgttgttgacgagtgtcatcgtgctgtatctgctaggaaacagtgggagatcaacggtttctttcataatgcactttggtatggctttactggcacacccatttttgagcagaatgcgcgtcctgaagagggaaatctgccgcgaacgactgcggagcaatatggtgagcgcttgcatgaatacacggtcaaagaagccattcatgatggagctgtcctaggttttcaagtggagtacactaacacgattcgggatgatcagcttactgagctagttgcgaagcgagcgaataagtcacttgccgaagtggccaagatggattctgttgagatggaaaagaacttacttccttctgactatctgaacaaaaaacatatgtggaaagtggttgaaagtatcgtcaaccgttcacaaagaaagctagggctgtataatgggcgcggcaactcttacactgcgttgttaacaacgagttcaatttcgcaggcgcagagatattacgacttgttcaaagaattaaacgccggtaaagcaccattcacgatcagcaaagcaactaaagagcgactacctgactttccaaagatcgccattacctattcggttactgaaaacgacgttaactcaactttgaatcaagacgcaatgagaaaatctattcgtgactataacgagatgtttggtacgagttatagtttggaaaatattcgtcaatataatgccaatatcaatgatcggctggcacgaaaacaagcccgttacctctctcgcgaggaacagcttgacattgtcatcgtggttgatcgtctattgacaggatttgatgcgccttgcctatcgacattgtttattgaccgtccgccaatgcagccgcagaacattattcaggctttttcaagaactaaccgaatttttgacaaaaacaagcaatatggacaaattgttgtctatcaacttccgcatacctttgccaaagcagtcgaagaagcattaattctctattcaaatggcggagaaaatgaaattctcgctcctgagtggaaagtagctcacaatcggctaaaaaaagcggccgcaagtttgaagaagttcacacttgatccttctgggccacctatcaatgagctaccagatgcgactttgaagcaatttgctaaggcatttcaaggttttgataaggggctggcggcagcgcaggtatatacagaatatgactctgacggcattaaagaagaacttgctattgatgataaagacatcgaagcttatacaagcgcttacaacaatgtcattgaggagttgaaacggcgcaaggtgactgacggatctgaagaagacgatatagacattgagtacgagttagaaatagtacagcaggcaacgatcaactacgaatacatcgttaatttaattcaagcctatgttagcgactctcgcgatgacaaaccggccgtgagtcaaaaacgagttgtagaaattaccaattacgtcgatagattaaaaaacaacaatgaaaaattaggcacgttgatggaaagcctatggcgtaagattcaagctaatccaaaaaaatttcaaaatcagaatgtccaaactttgcttcagacaatgaaaaacgaaacaatcgagcatttggtcaaggatgtcgcgacgacatggggtgccgatcctgcagaggcacttttctacgctgaaaattttgaccctaagaaagaatctaatcccggcgaagagagcttaaaacgtcatatggattatgaaatgtataaggaaaaaactgaaaatccggttaagaagatctcgtactggcgcgaatttaaagatgcatactcgaatcttattcgcgaagagatcttgccacttaatcaggactaa

SEQ ID NO: 38 - protein, 1016 aa, Lactobacillus casei
MGATLESTFEKRLIEQLTRGISQWTYRQDLKTEEDLWRNFRQKIEQNNVAVLDGHPLTEQEFRQIQNQLQFGTFYDAAKWLAGENGVAKVQVQREDATLGTVRLEVVRREDVAGGTSSYEVVNQIEMPKVFADYQNRRFDVSLLINGLPLIHIELKNADHSYMDAFRQIKKYLSDGMFNGIYSVVQMFVVSDPYHTRYIAPASGTKMNERFLTNWVDEHNQPVETLTDFTDQVLSIPQAHKMVTQYTVIDSIRKSLILLRPYQIHAIERVREATKHQVSGYVWHTTGSGKTLTAYKVARNLLQIPSIDKTIFIVDRVDLDQQTTSSFMAYAENDTIDIDETEHVRDLIKKLKSTDRTVIVTTIQKLNFVMRRFADKQGTRDYERLTKLKIAFVVDECHRAVSARKQWEINGFFHNALWYGFTGTPIFEQNARPEEGNLPRTTAEQYGERLHEYTVKEAIHDGAVLGFQVEYTNTIRDDQLTELVAKRANKSLAEVAKMDSVEMEKNLLPSDYLNKKHMWKVVESIVNRSQRKLGLYNGRGNSYTALLTTSSISQAQRYYDLFKELNAGKAPFTISKATKERLPDFPKIAITYSVTENDVNSTLNQDAMRKSIRDYNEMFGTSYSLENIRQYNANINDRLARKQARYLSREEQLDIVIVVDRLLTGFDAPCLSTLFIDRPPMQPQNIIQAFSRTNRIFDKNKQYGQIVVYQLPHTFAKAVEEALILYSNGGENEILAPEWKVAHNRLKKAAASLKKFTLDPSGPPINELPDATLKQFAKAFQGFDKGLAAAQVYTEYDSDGIKEELAIDDKDIEAYTSAYNNVIEELKRRKVTDGSEEDDIDIEYELEIVQQATINYEYIVNLIQAYVSDSRDDKPAVSQKRVVEITNYVDRLKNNNEKLGTLMESLWRKIQANPKKFQNQNVQTLLQTMKNETIEHLVKDVATTWGADPAEALFYAENFDPKKESNPGEESLKRHMDYEMYKEKTENPVKKISYWREFKDAYSNLIREEILPLNQD

SEQ ID NO: 39 - DNA, 3165 bp, Lactobacillus casei
ttggaactgtcgtttgaaaaagaagttgttaaaaccttaacgactggaagcaatcaatgggtggaacgaaaagacctatatggtgcgacgccggatcaattatgggctaattttcgtgataaattaaataacaataactatgctaaattgcagggataccctttaactgataccgaatttaatcaagttaaacgggcgattgaggtccggacaccttacgaagcagctaagttactagccgccgaaaatggcattggcaaagtggaagttgaacgtgatgatgctaagctgggcacggtgacgcttgagttgttttggaaagcggacgtcgctggtggtaaatctagttatgaagtggtccggcaagcagtgcgaccacggttagctggtactcaagatgtcgatcctgatcgccggtttgacgtaaccctattgattaatgggttacccttaattcaattggaactaaaaaaagccacggtcgaacttaaccaggcttttaatcaaattgaaaaatacgcgcaggaaggtaaatatacggggatttactcgctgttgcaaatgtttgtgattatgacgccggatagtacggcgtattttgcgaatgccgaaccggatcatttcaataaagcttttttgtttaattggcggacgcgggataatcaccccgtggaaaacggcttagcgttcacgcgccaagttcttaatattcccatggctcacaaaatggtcagtgaatatacagtcatcgaccaagagcggcaaagcctaattctcttacggccttaccagatttatgcgattgaagccgtgatgcaccggattcacgaccatcaagatggttttgtttggcataccacgggttctggtaaaacactcacctcatataaaaccgctaaattagctgcgcaagatcccggtgtcgataaggtcatcttcttagttgaccggcgggatttagacgaacagacaaccagcaactttagtgcctatgccgccaatgatgatattgccattaacgaagcccaaaacaccggtgatttaatgcgtaaattgcaacaaaatgacggtaaggtcttggtcacctcgattcaaaaacttcatcgggcggtcaaaaaaacgcaagcccagctggcaaccggtaagcaatcccgctttagtaagactttaaagcaacgagtgatcttctttgttgacgaagcccaccggtcgcagtttggtaagatgcaaaaggaaattcgagcagcgtttatcaatagtaactggtatggttacactggcacccccatttttaatgaaaataagaaacagctcaaaggtgatctagcagttacgacggaggagctatttggtaaagtctgtcatgtttataacttgcgagacgccttagaggaccaagccgtgttaccgtttaatgtggaacacgtaacgacgattggaaaagacacgttaataacccgggccctcgaaaaagaaactcagcgcgtcaaagcacgtcgcgataagcaaggccgcctgctgagtacagctgatgaagcaaaaattcaagccaagattcaagcgatgtcagtcaaggacttggaagaaacatatttaactccggctgactttgagaccgatgaacatattaaccaagttgttcaatatattttacaaaaaggcccacgtaaaacgagtttgggtcatggcaactataatgctattttgaccaccagttccattgaaatggcgcaacgctattatcaagcctttaaagccgctaaaaagactactcacaatcagctggatcctaattggccccgaattgcgattacttattcattaagtgaaaacgaagatcagagtgcgcaaaagcatgaccaaatggccaccattttaaaagattataatcagcagtatcacactaattttgatttagccgatttgaatctctataacgaagatgtcgcaaaacgggctgcccggcgtgaggcggtctttgctcatttgaaaccggatcaggaaattaatttagtgattgtggtgcggcggttattaacaggctttgatgcccctcggctaaacacgctctttgttgaccgcaccttagcttatcaagaactcattcaagcctactcacgcaccaaccggctccaaaaccgggaattaaaacaagagggtcaaattgtgacctttcgggtgccggcaatcatggaagctaatgaacgtgaagcttacaagttatatagtggcgaaggctcctttaatgtcatcattcgtcccacttatcagcaggccgtcttaaaatttcaaaaggctgtggtggatttaaaagccattgccccgacgccgacggcggccgatgacctgaaaggaaccactgctaaggtacagtttgtgaaagcctttcgccaagtgaatcagcaattgaattccttatccatgtacaacgatttcacttgggaaaacagtgaaaaggcctttggtatcgctcagcccgaagtagaatcctatacgggtaaatatctgcggattaaagcggcggttactaaccaagagcctgagaaagtccctgaagaattagctgccttagacttttccctagccgttggttcagtcgtcttggtggattatgattatttgacgcaattaattcaagattggattgatgaacagcaacagtacacgacacctgatcaagcccaagcccatatgatcgattacctgcaaaatagtgccaaagtacaggctagtttgaataaattagcggaaacgcaaccgcaacaggcccagttaattcgcgaagccatgccttatattgagcaacaaatgcaacagtctcagcaacagagcaccccaaatcaagtgccagtagcgttgaatgctcgggagttggtggctgattatgcccagagacaattggtcaaaaaaacgtcggtattcgcccatacgtggggcttagatcaaacagccctattgcgggtggcgcgtgaacacaccgtgggtaccgatgaatggcatcatgaacaagaattaacgcagtcagcgaatttagcagcggccttacaagctcaaactgccgctgggccgaagattccagctattttgccactataccggattaagtcccaggccgcttggcggcagtttattgaacacgatttagcaatttatctacaaaaataa

SEQ ID NO: 40 - protein, 1054 aa, Lactobacillus casei
MELSFEKEVVKTLTTGSNQWVERKDLYGATPDQLWANFRDKLNNNNYAKLQGYPLTDTEFNQVKRAIEVRTPYEAAKLLAAENGIGKVEVERDDAKLGTVTLELFWKADVAGGKSSYEVVRQAVRPRLAGTQDVDPDRRFDVTLLINGLPLIQLELKKATVELNQAFNQIEKYAQEGKYTGIYSLLQMFVIMTPDSTAYFANAEPDHFNKAFLFNWRTRDNHPVENGLAFTRQVLNIPMAHKMVSEYTVIDQERQSLILLRPYQIYAIEAVMHRIHDHQDGFVWHTTGSGKTLTSYKTAKLAAQDPGVDKVIFLVDRRDLDEQTTSNFSAYAANDDIAINEAQNTGDLMRKLQQNDGKVLVTSIQKLHRAVKKTQAQLATGKQSRFSKTLKQRVIFFVDEAHRSQFGKMQKEIRAAFINSNWYGYTGTPIFNENKKQLKGDLAVTTEELFGKVCHVYNLRDALEDQAVLPFNVEHVTTIGKDTLITRALEKETQRVKARRDKQGRLLSTADEAKIQAKIQAMSVKDLEETYLTPADFETDEHINQVVQYILQKGPRKTSLGHGNYNAILTTSSIEMAQRYYQAFKAAKKTTHNQLDPNWPRIAITYSLSENEDQSAQKHDQMATILKDYNQQYHTNFDLADLNLYNEDVAKRAARREAVFAHLKPDQEINLVIVVRRLLTGFDAPRLNTLFVDRTLAYQELIQAYSRTNRLQNRELKQEGQIVTFRVPAIMEANEREAYKLYSGEGSFNVIIRPTYQQAVLKFQKAVVDLKAIAPTPTAADDLKGTTAKVQFVKAFRQVNQQLNSLSMYNDFTWENSEKAFGIAQPEVESYTGKYLRIKAAVTNQEPEKVPEELAALDFSLAVGSVVLVDYDYLTQLIQDWIDEQQQYTTPDQAQAHMIDYLQNSAKVQASLNKLAETQPQQAQLIREAMPYIEQQMQQSQQQSTPNQVPVALNARELVADYAQRQLVKKTSVFAHTWGLDQTALLRVAREHTVGTDEWHHEQELTQSANLAAALQAQTAAGPKIPAILPLYRIKSQAAWRQFIEHDLAIYLQK

SEQ ID NO: 41 - DNA, 3051 bp, Lactobacillus casei; identical to SEQ ID NO: 37

SEQ ID NO: 42 - protein, 1016 aa, Lactobacillus casei; identical to SEQ ID NO: 38

SEQ ID NO: 43 - DNA, 3165 bp, Lactobacillus casei; identical to SEQ ID NO: 39

SEQ ID NO: 44 - protein, 1054 aa, Lactobacillus casei; identical to SEQ ID NO: 40

SEQ ID NO: 45 - DNA, 3051 bp, Lactobacillus casei; identical to SEQ ID NO: 37

SEQ ID NO: 46 - protein, 1016 aa, Lactobacillus casei; identical to SEQ ID NO: 38

SEQ ID NO: 47 - DNA, 3168 bp, Lactobacillus coryniformis
atgttggaactgtcgtttgaaaaagaagttgttaaaaccttaacgactggaagcaatcaatgggtggaacgaaaagacctatatggtgcgacgccggatcaattatgggctaattttcgtgataaattaaataacaataactatgctaaattgcagggacaccctttaactgataccgaatttaatcaggttaaacgggcgattgaggtccggacaccttacgaagcagctaagttactagccgccgaaaatggcattggcaaagttgaagttgaacgtgatgatgctaagctgggcacggtgacgcttgagttgttttggaaagcggacgttgctggcggtaaatctagttatgaagtggtacggcaagcagtgcgaccacggttagctggtactcaagatgtcgatcctgatcgccgttttgacgtaaccctattgattaatgggttacccttaattcaattggaactaaaaaaagccacggtcgaacttaaccaggcttttaatcaaattgaaaaatacgcgcaagaaggtaaatatacgggaatttactcgctgttgcaaatgtttgtgattatgacgccggatagtacggcgtattttgcgaatgccgaaccggatcatttcaataaagcctttttgttcaattggcgaacgcgggataatcaccccgtggaaaacggcttagcgtttacgcgccaagtccttaatattcccatggcccacaaaatggtcagtgaatatacggtcatcgaccaagaacgtcagagcttaattctcttacggccttatcagatttatgcgattgaagccgtgatgcaccggattcatgaccatcaagatggctttgtttggcataccacgggttctggtaaaacactcacctcatataaaaccgctaaattagctgcgcaagatcccggtgtcgataaggtcatcttcttagttgaccggcgggatttagacgaacagacaaccagcaactttagtgcctatgccgccaatgatgatattgccattaacgaagcccaaaacaccggtgatttaatgcgtaaattgcaacaaaatgacggtaaggtcttagtcacctcgattcaaaaacttcatcgggcggtcaaaaaaacgcaagcccagctggcaaccggtaagcaatcccgctttagtaaaactttaaagcaacgggtgatcttctttgttgatgaagcccaccggtcgcaatttggtaagatgcaaaaggaaattcgggcagcgtttgtcaatagtaattggtatggttacaccggcacccccatctttaatgaaaataagaaacagctcaagggtgatctagcggtcacgactgaggagctatttggtaaagtctgtcacgtttataacttgcgagatgccttagaggaccaagccgtgttaccgtttaacgtcgaacatgtaacaacaattggcaaagatacgttaataacccgggccttcgagaaagaaacccagcgcgtcaaagcacgtcgcgataagcaaggccgcctgctgagtacagctgatgaagcaaaaattcaagccaagattcaagcgatgtcagtcaaggacttggaagaaacgtatttaactccggctgactttgagaccgatgaacatattaaccaagttgttcaatatattttacaaaaaggcccgcgtaaaaccagcttggggcatggcaactacaatgctattttgaccaccagttccattgaaatggcgcaacgctattatcaagcctttaaagccgctaaaaagactactcacaatcagctagatcctgattggccccggattgcgattacttattcattaagtgaaaacgaagatcagagtgcgcacaaacatgaccaaatggccaccattttaaaagattataatcggcagtatcacactaattttgatttaactgatttgaatctctacaacgaagatgtcgcaaaacgggccgcccggcgtgaggccgtctttgctcatttacaaccggatcaagaaataaatttagtgattgtcgtacgccgtttattaacaggctttgatgcccctcggctaaacacgctctttgttgaccgtaccctagcctatcaagaactcattcaagcttactcacgcactaaccggctccaaaaccgagaattaaaacaagagggtcaaatcgtgacctttcgggtgccggcaatcatggaagctaatgaacgtgaagcttacaagttatatagtggcgaaggctcgtttaatgtcatcattcgtcccacttatcagcaggccgtcttaaaatttcaaaaggctgtggtggatttaaaagccattgctccaacgccgacggcggccgatgacctgaaaggaaccactgccaaggtacagtttgtgaaagcctttcgccaagtgaatcagcaattgaattccttatccatgtacaacgatttcacttggaaaaatagtgaaaagacttttggtattgctaagcccgaagtagaatcctatacgggtaaatatttgcgaattaaagcggcggttactaaccaagagcctgagaaagtccccgaagaattagccgccttagacttttccttagctgttggctcagtcgtcttggtggactatgattatttgacgcaattaattcaagactggattgatgaacagcaacggtactcgacgcctgatcaagcccaagcgcatatgacagattacctgcaaaacagtgccaaagtacaggctagtttgaataaattagcggaaacgcaaccgcaacaggctcaattaattcgcgaagccatgccttatattgagcaacaaatgcaacagtctcagcaacagagtgaccaaaatcaagcgccagtagcgttgaatgctcgggagttggtggctgattatgcccagagacaattggtcaaaaaaacgtcggtattcgcccacacgtggggcttagatcaaacagccctattgcgggtggcgcgtgaacacaccgtgggtaccgatgaatggcatcatgaacaagaattaacgcagtcagcgaatttagcagcggccttacaagctcaaactgccactgggccgaagattccagctattttgccactataccggattaagtcccaggccgcttggcggcagtttattgaacacgatttagcaatttatctacaaaaataa

SEQ ID NO: 48 - protein, 1055 aa, Lactobacillus coryniformis
MLELSFEKEVVKTLTTGSNQWVERKDLYGATPDQLWANFRDKLNNNNYAKLQGHPLTDTEFNQVKRAIEVRTPYEAAKLLAAENGIGKVEVERDDAKLGTVTLELFWKADVAGGKSSYEVVRQAVRPRLAGTQDVDPDRRFDVTLLINGLPLIQLELKKATVELNQAFNQIEKYAQEGKYTGIYSLLQMFVIMTPDSTAYFANAEPDHFNKAFLFNWRTRDNHPVENGLAFTRQVLNIPMAHKMVSEYTVIDQERQSLILLRPYQIYAIEAVMHRIHDHQDGFVWHTTGSGKTLTSYKTAKLAAQDPGVDKVIFLVDRRDLDEQTTSNFSAYAANDDIAINEAQNTGDLMRKLQQNDGKVLVTSIQKLHRAVKKTQAQLATGKQSRFSKTLKQRVIFFVDEAHRSQFGKMQKEIRAAFVNSNWYGYTGTPIFNENKKQLKGDLAVTTEELFGKVCHVYNLRDALEDQAVLPFNVEHVTTIGKDTLITRAFEKETQRVKARRDKQGRLLSTADEAKIQAKIQAMSVKDLEETYLTPADFETDEHINQVVQYILQKGPRKTSLGHGNYNAILTTSSIEMAQRYYQAFKAAKKTTHNQLDPDWPRIAITYSLSENEDQSAHKHDQMATILKDYNRQYHTNFDLTDLNLYNEDVAKRAARREAVFAHLQPDQEINLVIVVRRLLTGFDAPRLNTLFVDRTLAYQELIQAYSRTNRLQNRELKQEGQIVTFRVPAIMEANEREAYKLYSGEGSFNVIIRPTYQQAVLKFQKAVVDLKAIAPTPTAADDLKGTTAKVQFVKAFRQVNQQLNSLSMYNDFTWKNSEKTFGIAKPEVESYTGKYLRIKAAVTNQEPEKVPEELAALDFSLAVGSVVLVDYDYLTQLIQDWIDEQQRYSTPDQAQAHMTDYLQNSAKVQASLNKLAETQPQQAQLIREAMPYIEQQMQQSQQQSDQNQAPVALNARELVADYAQRQLVKKTSVFAHTWGLDQTALLRVAREHTVGTDEWHHEQELTQSANLAAALQAQTATGPKIPAILPLYRIKSQAAWRQFIEHDLAIYLQK

SEQ ID NO: 49 - DNA, 2973 bp, Lactobacillus coryniformis
atggcggaagataaatttgaacaagctgtaattgacaagctaaagagtgaaggttgggaatatctaacggattattctggtgtaacagttgatcggttatatgatcactggcgagatattctgaatgccaacaatcgtaaacgactagaagatacgccgttatctgataatgagtttaaacaagtgaagttggaactaacgaagaataaaacgccgtatgatgcgcaactcatgttggcgggtgcgggtggtgttgggaccgtaccgttgaatcgtgatgatgggacgcagctagaacttgaaatattctatggtgatgaagtggcaggtgggcattcacgttatgaagtcgttaaccaaattacgtttacggatttagcaacgagtctaagctctaagcgtcgaattgatatcatgttactgattaacgggctacctgtggcccacattgaagaaaaagatgagtccctgcaaaaccagtggaatgcgtttgagcagttccaaaagtatgacggtgacggcatgtacacgggactcttttcttttgtgcaagtgcaattcgttctatcacaaaattcagcgcactattttgcacgaccaaagaatagtgactcatacaaccgtgacttcgcctttggctggcgtgacgatgccggcaaggatgtcacgaatacgatgacctttattcatgaggtgatgggtgttccagctttacaccgcttagtaactgtgaatatgattccggatgcagccaatgataacttaatggtcatgcgctcgtatcagattcaagcaacgcggcaaattttagatcgcatgcgtgagatggatcaaaacgggttggttgaaaaagaagggggctacgtttggcacaccacgggttctggtaaaacagtcacctcatttaaagtggcgcaactactggcttcacgaccacgggttgaagatgttttgtttattgtggatcgggttgacttagtcaatcagacctatgaaaactttaagtcatttgcctataagacctttgaaaatcggattcaagtggtgaatgggagtgaactaaagcgtgctcttaagcacgataacacggcccatatctatttgattacggtacaaggcttggataaggccattaaatcaggtctagcctctaataagcggatggttattttaatggatgaggcccaccgatcagccagtggtgatgccgtcagccgaattaaacaagcgttacccaaaaccacttggtttgggtttacagggacgcctaatttttatagcgatgaagtccatgacgtgaaaacctctaaggatatttcaacctatgatattttcgggccgcgtttacaccggtatacgattaaggacgctattggtgacggtaacgtccttgggtttgatgtgacgtattatgagactgattttgaacacgatctggatagtggtttaactgaaaaggaactggaaaaagaagtatatgccagtctgccattccgccaagccgttgtggcagatattcagcgtaattgggctacgaatgctagcggaccaattaacatgggtgtccgcgagccgaatcaattccaaggtatgttagcggtgtctggtaagcaagccgttgcttcttattacagtcttttcaagcaactagcacctgagttacgtgttgcgatgacctattcgcgtgatgaagccaatgggacgggggcgtcagatttacaagctgctttaaagcaagcgatgcaagactacatgacgttctacggcacacgtaatttcttagaggacaaggatccacaacgggcgtacctcaatgatatgaccaagcgcattgcccgtaagaaaccttataacaagggtaatgatgccgatcgactggacttgattattgtgtcagatcaattattgacaggatttgattcaaaattcgttaatatcatctacatggataagattttgggtgaaggtcccctgattcaagcaatgtcacgaactaaccggacaattgataagacagctaaacctcatggtaaagtgcgtttttatcgtcaaggtgcggtaatggaagaaaaagtgaaggatgcgttggttatctataccaaagggggcaatgataccttagcggatgcggggaataccccggatgatcaggaacaaaaagagttgtttgatgaaggaattttggcgcctaaggcagctgataaaattatcgacttgaacccccaaatcaagcgtttgcagcaattagcgggtgatgatttttcacagatgccgcgttctgaaaaagaacaagtcgagtttgccgtgacagccgcccaagttaactcgcaagtccaacaattagtgcaacaaggatatgtcttggggaactctgttgaaggaccagaaggacctatcacactgggcattgagagtgcaacgcagctcagctcattgcaagcacgcatgaacgatgtgaatgaagtcttaccagctgacaagcaagttgatttaacgaatatcaagctggtgttgcaatcctttgcgaatgaaattattgattacgataaactagtcgatttattgaatgcgtatatggatgaagtcagtgttgccaaccgtgcagccgttgaagagcatgtacagcccttagatcaagataatcgtgaagaaatcggacaagtcttagatggtatcgaacaaggggagtatacggagccttttacaactgaaacactcaagtcagtccgtaaggcgatccgcactgcgcaacaagacttaaaaatttacaaatgggcagccgaccatgattacaatggcaacgatattctagcagcttacgagctataccgccccggcattccattagttgataacacggcgctgaatcaatatttacaagacttagagagtcacttggacattggcttctttgagctagctgactttgaagagtcgctactgaactactttgctaaaattaccaaaaaataa

SEQ ID NO: 50 - protein, 990 aa, Lactobacillus coryniformis
MAEDKFEQAVIDKLKSEGWEYLTDYSGVTVDRLYDHWRDILNANNRKRLEDTPLSDNEFKQVKLELTKNKTPYDAQLMLAGAGGVGTVPLNRDDGTQLELEIFYGDEVAGGHSRYEVVNQITFTDLATSLSSKRRIDIMLLINGLPVAHIEEKDESLQNQWNAFEQFQKYDGDGMYTGLFSFVQVQFVLSQNSAHYFARPKNSDSYNRDFAFGWRDDAGKDVTNTMTFIHEVMGVPALHRLVTVNMIPDAANDNLMVMRSYQIQATRQILDRMREMDQNGLVEKEGGYVWHTTGSGKTVTSFKVAQLLASRPRVEDVLFIVDRVDLVNQTYENFKSFAYKTFENRIQVVNGSELKRALKHDNTAHIYLITVQGLDKAIKSGLASNKRMVILMDEAHRSASGDAVSRIKQALPKTTWFGFTGTPNFYSDEVHDVKTSKDISTYDIFGPRLHRYTIKDAIGDGNVLGFDVTYYETDFEHDLDSGLTEKELEKEVYASLPFRQAVVADIQRNWATNASGPINMGVREPNQFQGMLAVSGKQAVASYYSLFKQLAPELRVAMTYSRDEANGTGASDLQAALKQAMQDYMTFYGTRNFLEDKDPQRAYLNDMTKRIARKKPYNKGNDADRLDLIIVSDQLLTGFDSKFVNIIYMDKILGEGPLIQAMSRTNRTIDKTAKPHGKVRFYRQGAVMEEKVKDALVIYTKGGNDTLADAGNTPDDQEQKELFDEGILAPKAADKIIDLNPQIKRLQQLAGDDFSQMPRSEKEQVEFAVTAAQVNSQVQQLVQQGYVLGNSVEGPEGPITLGIESATQLSSLQARMNDVNEVLPADKQVDLTNIKLVLQSFANEIIDYDKLVDLLNAYMDEVSVANRAAVEEHVQPLDQDNREEIGQVLDGIEQGEYTEPFTTETLKSVRKAIRTAQQDLKIYKWAADHDYNGNDILAAYELYRPGIPLVDNTALNQYLQDLESHLDIGFFELADFEESLLNYFAKITKK

SEQ ID NO: 51 - DNA, 324 bp, Lactobacillus coryniformis
atgccaaataaccaatcatttactaatgaacaagaagttgaagaagaagcaattgatcttattgtctctcttggctacacagatttacgcagtgctgagtataaccggcccaatattcaggtagatagcgaacgcgataatgaccatcagaaaattgtacttgagccaagactaatggctgcattcaaacaaataaatcctggtctgccgaattttgtttatacagaagcattgcgtcagtttaaaagcattccagacggaccagatttaatggcaaataaccatcatttccacaagttactgattgaaggcgcatcagtaact

SEQ ID NO: 52 - protein, 108 aa, Lactobacillus coryniformis
MPNNQSFTNEQEVEEEAIDLIVSLGYTDLRSAEYNRPNIQVDSERDNDHQKIVLEPRLMAAFKQINPGLPNFVYTEALRQFKSIPDGPDLMANNHHFHKLLIEGASVT

SEQ ID NO: 53 - DNA, 1860 bp, Lactobacillus coryniformis
gacggagttagatatggtttcgcacagtatttacgtgattcgttgccaaatgcttcgtttattggctttacaggaacaccaattaatatcgatgataagtccacaacgggagtatttggtgattatatcgatatttatgacatgacacagtcagttcgtgatcacacaaccgttcgaatcttttatgagaatcacgttattcccttagccgctgacccagaagtacagcataagtacgaagctttaatagacgaagcagggcaagacgatcctgaagttactgatgatcagaaaagaaaagctgattttaccagcttggaacggttagctggggcaactagccgtttaaagactttagcaaagcattttgtgcatcattttgaggctcatcaagcagtacaatttggtaaagccatcatagttgaaacgtcaaggcgtaatgcagttaaactttttaatgagatcgttaagttgcggccgttatggtactcagatgatttaactaaaggaaaaatcaagattgttatgacatcagataccgcttctgatggtcctgaattagccaagcatcatactaatactaaacagcgaagagccttccagcaaaggatgaaagatgataatgatgaactacaaatcgttattgtcgtaaatatgtggctaacaggttttgatgcgccttcggttaatacaatgtatgttgataaaccaatgcatggacacaatttgatgcaggctattgcacgagttaatcgagtttttcgagataaagacggcggactaattgttgattacattgggattgctgatagtttaaatcaagcgcttagacattattctaaaaatgatcgtgatcaagctggaattaacgttgataaagcagtgtcattaatgaaatctaaatacgatattatcatcaatgattacctgtatggtgttaattatagtggctacaatagtgatatacgtggtaagcgtcaagaatcttatcgattagcacttgatgctgtagttagcttagataaagaacagcaaaaaaagtttgcggatactgtggtgcaactacaaaaagtttacgcacttgtggtaacaagcaagcaggcacaagcaatttcttcagaagtagctttctttggtgctgtcaaaagtgcattgatgaagattttgcaagcggtgagtccacatgataatcctgtcacaaatcgagaactaaatttgcgattagatcagcttgtaaaccaatcagtaatagctaaacagcctgtcgatttatataaagaattagggcttgaacgaccagaactaagtttactgtccgaaaaatttttagatagtatccaaaatatgccagaacaaaatttggcagtgaagttattagagcgattgcttaagggtaaagttaaagcattgactaaggttaatctaattcaatcacggaggtttggtgatatgcttgaaaacaatattgaagcattaaatcaacgtggggtgacgactgagattgttattcgaaaattgattgaattagctaaaaatatgcaggaaacagaagcagctggcgaaagcttaggactgagtgccaatgaacaagcgttttacgatgcattatgtgatcaaaagactgctgtgcacgtcatgggtgaagatacgttacaagaaattgccaaagaattggtaggaactgtgcgtaaatatgcatctactcctgactgggttcaaaggaagacgacacaagccgctatgcggcaagctgtccgccgtatgttaaaagatcatgggtacccgccaacatttgcacccgctgcagtagataccattattgaacaggcgcagacaatggcatttgaaaatcacaactag

SEQ ID NO: 54 - protein, 619 aa, Lactobacillus coryniformis
DGVRYGFAQYLRDSLPNASFIGFTGTPINIDDKSTTGVFGDYIDIYDMTQSVRDHTTVRIFYENHVIPLAADPEVQHKYEALIDEAGQDDPEVTDDQKRKADFTSLERLAGATSRLKTLAKHFVHHFEAHQAVQFGKAIIVETSRRNAVKLFNEIVKLRPLWYSDDLTKGKIKIVMTSDTASDGPELAKHHTNTKQRRAFQQRMKDDNDELQIVIVVNMWLTGFDAPSVNTMYVDKPMHGHNLMQAIARVNRVFRDKDGGLIVDYIGIADSLNQALRHYSKNDRDQAGINVDKAVSLMKSKYDIIINDYLYGVNYSGYNSDIRGKRQESYRLALDAVVSLDKEQQKKFADTVVQLQKVYALVVTSKQAQAISSEVAFFGAVKSALMKILQAVSPHDNPVTNRELNLRLDQLVNQSVIAKQPVDLYKELGLERPELSLLSEKFLDSIQNMPEQNLAVKLLERLLKGKVKALTKVNLIQSRRFGDMLENNIEALNQRGVTTEIVIRKLIELAKNMQETEAAGESLGLSANEQAFYDALCDQKTAVHVMGEDTLQEIAKELVGTVRKYASTPDWVQRKTTQAAMRQAVRRMLKDHGYPPTFAPAAVDTIIEQAQTMAFENHN

SEQ ID NO: 55 - DNA, 3219 bp, Lactobacillus crispatus
atgtctaactttgaaacttcacaaaaagattatcaagaatacgcaaaattggcttccagcgctgaaagcttaatttactctgatcctagaagtagtttgacagttttcggaacttttggtgagcaattaactaaggaaatcatgcatttggatgatttaggtgattgggaattaaaccaaaaacaacgaattgaaaaaatggcatattctaagaatgaatatccacctactgttttgaatgctcttaatttgatcaggttaagacggaacaaggcagcgcatgacgatcattttattgctaccaaaaagattgcgcttgaaattgatcagagtgcttatttggtatggaaatggtttttagaagtttattctctggatgaagttgcagattatgttgagtcacaagatcaaaaagctttaattaaaactcaagaagataaaatcaaagctctcgaagaaaagataaagcaattacaacaaaatagggtgcaggaagtcataatttctcctgaagagcgtgaacgcagacgccagattaacgttcagtttgctaaaaaacatgagttaactgaagcagaaacacgtcagttaattgatcaacaattgcgagatgcgggctgggaagtagattcacaaaaattgaacaattggacgcagaaaactgaaccgcaaaaaggtcacaatatggcaattgctgaatgggttctacctaatggtcagcgagcagattatgcattattcaaaggtttgaagttctacggaattgttgaggccaaaaagtgggaccaagatattgcagggcaaatggcacagcctaaggaatattctaaagaggtaccatttagatcagattatcgtctagtttcaaatgaaatgggtgattacaaagttccattcatctatactgcaaatggtcgtccatatcttaaacaatatcaggaaaaatctggtatttggttctgggatgcacgtaatcctaaagaaagcgcatatgctcttgaggaatttcataagccagaagatttatcgttgaagctttctgctaaaaataaagaagaagcaaatcaagacttggtagatgatcaagattttcctgattttgcacatcgtgaatatcaaattgctgcaattcaagcgatggaaaatgccatcaaagatggaaaaaagcgtattctgcttgccatggcaacaggtactggtaaaactagaacggcaattgctttaatgtacagactacttaagcataagagagctagacgtattctttacctagttgaccgtaattcattgggaaagcagactgccaatgcaattaaagataataaaataggtacgatgtcaatttcttccatttatggattaaaggaattgagtgataaggcacctgaaatatcaacaaaaattcaaattgcaacggttcaggggatgatcaaacgcctatttttcagtgaagacagtgatgataagccatccgttggtcaatatgattttattattgttgatgaagcccaccgtggttatgcagaagataaagagctcagcgataaagaatatcaattctatagtcaagaagattatgttagtcaatatagacgtgtagttgattattttgatgcgactgctattggaatgactgctacgccagctttacaaacgattgatatttttggcaaaccggtgtattcgtatagctaccaacaagctgtcctcgatggctggttagtggatcatgatgcaccagtaattattcaaactcaattatctcaagaagggattcattttaaaaagggtgccgaagttagtctttttgatcaggatgaaaaaactatcaataaagaaaaattacctgataatatgaattttgatgtaaaagactttaataagagagttatcacacgtagctttaatgaagtagtttgtgatgaattagctcaaagatatcttgatccaagtgatccaaatttaggtaaaactttaatctttgcggcaactgatgaacatgctgatatggttgttgacttattgaaaaaagcattcaaaaaagcgggtaatcctgtagatgacgatgctatcgaaaaaattactggttcaattcggcatcctaatcaagaaattaaaaactttaagaatgaaaccaaccccaatattgcagtaactgtagacttgctaactacgggaattgatgtaccgcaaattactagtattgtcttcttaagaagagttcaatcaagaatcctctatgagcaaatgttgggacgggcaacgagactttgtcccgaaattaataaatccaaatttacgatttatgatgctgtcggaatctatgaagcaatgaataaagtgacaaacatgaagcctgttgttaaaaatccaggacataatgttcactacttcttaaatcacaaggatgatttctttgagacaaatgaggattccgctcagtatcaagtagatatggctggtgccgttgagagaaaaattaaacgtttggatgatactaaacgtgatgagttccaacatctagctgagattaattcagttgatcaatgggcccgtgaattaagtaagttagataaggcccattttttacagcaatggcctaagtttgagcagttagaccacattagcccagtcaaatccaagcaaataatatctgacgcagtagacaaagtagttaatgtaagtcgaggttatgggcatggcaatcaaaaaccagcggattatattgaaaacttcaataaattcgttaaggaaaatgtcaatactattccagccttacaagttgtagctactagaccgaaggatttaacttttgatgaactcaaaaatattaaacttaagctagagcaaaatggctttaaagaaaatgatttgcaaagtgcatggaaaaacgttaaccatgttcagaccactgccgatattattagcttcattagacaagctgcggctggatctgagttggtggatcatgatgttagaattcataatgccatgcaaaaagtttatggtttagctgattggactattcctcaaaagaaatggttgaagagaattgagaaccaattaatttcatctactgtattggggccaaatgctgagaaagcctttgatgataactatttctttaaacgtcacgggggttataagcaaattaagaagatctttccagaaaatgttgatcagattatttacgtgttgaatgagaatttatatgtttaa

SEQ ID NO: 56 - protein, 1072 aa, Lactobacillus crispatus
MSNFETSQKDYQEYAKLASSAESLIYSDPRSSLTVFGTFGEQLTKEIMHLDDLGDWELNQKQRIEKMAYSKNEYPPTVLNALNLIRLRRNKAAHDDHFIATKKIALEIDQSAYLVWKWFLEVYSLDEVADYVESQDQKALIKTQEDKIKALEEKIKQLQQNRVQEVIISPEERERRRQINVQFAKKHELTEAETRQLIDQQLRDAGWEVDSQKLNNWTQKTEPQKGHNMAIAEWVLPNGQRADYALFKGLKFYGIVEAKKWDQDIAGQMAQPKEYSKEVPFRSDYRLVSNEMGDYKVPFIYTANGRPYLKQYQEKSGIWFWDARNPKESAYALEEFHKPEDLSLKLSAKNKEEANQDLVDDQDFPDFAHREYQIAAIQAMENAIKDGKKRILLAMATGTGKTRTAIALMYRLLKHKRARRILYLVDRNSLGKQTANAIKDNKIGTMSISSIYGLKELSDKAPEISTKIQIATVQGMIKRLFFSEDSDDKPSVGQYDFIIVDEAHRGYAEDKELSDKEYQFYSQEDYVSQYRRVVDYFDATAIGMTATPALQTIDIFGKPVYSYSYQQAVLDGWLVDHDAPVIIQTQLSQEGIHFKKGAEVSLFDQDEKTINKEKLPDNMNFDVKDFNKRVITRSFNEVVCDELAQRYLDPSDPNLGKTLIFAATDEHADMVVDLLKKAFKKAGNPVDDDAIEKITGSIRHPNQEIKNFKNETNPNIAVTVDLLTTGIDVPQITSIVFLRRVQSRILYEQMLGRATRLCPEINKSKFTIYDAVGIYEAMNKVTNMKPVVKNPGHNVHYFLNHKDDFFETNEDSAQYQVDMAGAVERKIKRLDDTKRDEFQHLAEINSVDQWARELSKLDKAHFLQQWPKFEQLDHISPVKSKQIISDAVDKVVNVSRGYGHGNQKPADYIENFNKFVKENVNTIPALQVVATRPKDLTFDELKNIKLKLEQNGFKENDLQSAWKNVNHVQTTADIISFIRQAAAGSELVDHDVRIHNAMQKVYGLADWTIPQKKWLKRIENQLISSTVLGPNAEKAFDDNYFFKRHGGYKQIKKIFPENVDQIIYVLNENLYV

SEQ ID NO: 57 - DNA, 3210 bp, Lactobacillus curvatus
atgaacgaattaaatttcgaatcagaattaattaaatatattacaagtgggacaataacagtttctgaggatgattttcaaaaaagtaatattcgtgaaacagcaaaagattatgttgtgaagactaagctgtggcagtatcgagacgatattagaacaactgaacaactatgggctaattttaagcagattttagagcagcataatcaaaatacactcgataatccgctaagtgtcatggaatttaatcaggtgaagaaaatcatttcagatttaaaaacaccgtatgatgctggtcaatttttatatgggttaaatggtgtctctcagattgaaattgatttagatgatggtcggcatgtgtttttaaccgtttttgatcagaaacaaattggcgctggtaatacagtctatcaagtcgtcaatcaaattgaacgaccagcattactaactgggaagcaagaacggcggtttgacacaacattattaatcaatggcttaccaattattcaaattgaagagaaacgagattcacatgatgttaatgaagcacttaatcagatgcatcaatatattttagaaaatcaatacactgacattttttcaacattacagattctggtggcaattacgccgaataatgttaaatatatggccaatacaacggcagataaatttaacaaagatttcgcgtttaattggcaacgaaaatcagacaacaagattgtccgtaattggcgcgaatttgcagattcaatgctaagtatcccaatggcccatcaaatggcgactaactttatgattttggatggtactaagaataaacaaatgattaaagtgatgcgcccttatcaagtttacgcaacacaaaatgtcattcaaaaaataaaaaaagttgattttgatatgggactaaacaaaattggctatatctggcatacaacgggttcgggtaagacaatcaccagttttaaaacagcatggcttgctagccgaatgccgggagtcgataaagttgttttcgttgttgaccgaattgctttaacaaagcaaacgaatgaaaattacaaagcgtatgatcctgatggtgcagtggatgatgatagtcgctctggcagtgtgcaagggacacagagtaccaacgacttaagccggaaattaaagagcaaggataacaatatcattgttacctcagtccaaaaactagaaacactggttaagcgtaagagttttaagtcacctgataaacacattgtctttattgtcgatgaagcacaccggtcaactggtggggatgcttttgaactattgcaaaagagctttaaaaaatctgcatgggttggttatacaggcacaccaatgtttgatgaaacaactaacggtttacgaactgaagatatttttggcgaattattacatgcttacacgattaaagaagccattgctgatcgaaatgtattagggtttaaagttgattttgagacaacaattgatacggaaagtatgaaaacacaatacttaccggacttttataaaaagcaacatcccgattgggaacagcgtcagattcaagataaaattgataatttatcacaagaagatatggatgacgaaattgcacctagtttctatgatgaaaatgaagatcatgttcacttagtcgttcaggatatttttaagaattggcgtaatcgttctaatgaaggaaagtacaatgcactatttacaacccatgttggtggtggtaaagcaagtacgccaatggccatgatgtactttaaagaatttcaacgggtcaatgaagagcatgcaaaaaacggtggccaattactgaaagttgcgattacatttagtcaaaataccacgaataaagatggcatggtcgaaaccaatcagaatttacatgatgcgatgaaggtttataatcatcaatttggaacaagttttgggttagatgacgtttctggctatacgcaagatgttacgagtcgccttaatcgaactgcaactgacaagaactacctagatttagtgattgtcgtggatcaattactaaccggatttgatgcgccagaaatgaataccttgtatgttgatcgtactttaaaaggggcaggtctaattcaagcgtactctcgaacaaatcgaatcgctgatatgaaagaaaaaccttggggacgagtcgttaactatcggtggcctagtcagaatgaaaagttaatgaataaggcgctagcgatttattccaataaggattcagccactttatcagaaaaagaacagcaaaaggaaaacgtcgattctggagttttagcgaaagactttaaaaatatggtccaagaggttcgtgggattgtcggacaactggatgatttaacggatggttttaatcaattaccaccaagtgaacgccaaaaggacgagatgtttgaattattgcgacaatacaacgtcggtatgtcgaaacttaaacaatatacaccgcaagatggtgaagaagatagtggatttaactatgatacgccggacgatttaattcgtgctttagggatgacaccggcacaagaaaaggaattgaccactgttttaacgaatgaaataaaacaatacattagtgtgcgggataaagtgcctgttcagcaaattgagttaaagatgacgcacatcaaagatgttcaggtcaactacgattacttgacggaactcgttgaaaaactcttgaatgaaatgcatgaagaaaaaattgaggctgctcagaagacgaagaaggatattgatcaatttgcaaatggcttagaagaccaaaattatgcgcacaaaattaaaaacgcgacacaagcgatccttgatggctactatccacctaaagggatggcaatgatatatcctgtcaagttggacgatagtgagcaagttattcaagaagctaatcagattagtattgatcggattttattagaatttcgaaaccagtgggggatcacagatgtgattacaagtgctgggttacgacaactatttagtacgcatcaatatggccaacaagatttagatgatgctggccaattgcgagatattattgctgaagcaagtttgagttataagaatttagcattagatactgatatccaagcactttcgaaaatcaggtaccgaaacggattacgcgaagcaatttatttagcagctgataaacatgtaatacattaa

SEQ ID NO: 58 - protein, 1069 aa, Lactobacillus curvatus
MNELNFESELIKYITSGTITVSEDDFQKSNIRETAKDYVVKTKLWQYRDDIRTTEQLWANFKQILEQHNQNTLDNPLSVMEFNQVKKIISDLKTPYDAGQFLYGLNGVSQIEIDLDDGRHVFLTVFDQKQIGAGNTVYQVVNQIERPALLTGKQERRFDTTLLINGLPIIQIEEKRDSHDVNEALNQMHQYILENQYTDIFSTLQILVAITPNNVKYMANTTADKFNKDFAFNWQRKSDNKIVRNWREFADSMLSIPMAHQMATNFMILDGTKNKQMIKVMRPYQVYATQNVIQKIKKVDFDMGLNKIGYIWHTTGSGKTITSFKTAWLASRMPGVDKVVFVVDRIALTKQTNENYKAYDPDGAVDDDSRSGSVQGTQSTNDLSRKLKSKDNNIIVTSVQKLETLVKRKSFKSPDKHIVFIVDEAHRSTGGDAFELLQKSFKKSAWVGYTGTPMFDETTNGLRTEDIFGELLHAYTIKEAIADRNVLGFKVDFETTIDTESMKTQYLPDFYKKQHPDWEQRQIQDKIDNLSQEDMDDEIAPSFYDENEDHVHLVVQDIFKNWRNRSNEGKYNALFTTHVGGGKASTPMAMMYFKEFQRVNEEHAKNGGQLLKVAITFSQNTTNKDGMVETNQNLHDAMKVYNHQFGTSFGLDDVSGYTQDVTSRLNRTATDKNYLDLVIVVDQLLTGFDAPEMNTLYVDRTLKGAGLIQAYSRTNRIADMKEKPWGRVVNYRWPSQNEKLMNKALAIYSNKDSATLSEKEQQKENVDSGVLAKDFKNMVQEVRGIVGQLDDLTDGFNQLPPSERQKDEMFELLRQYNVGMSKLKQYTPQDGEEDSGFNYDTPDDLIRALGMTPAQEKELTTVLTNEIKQYISVRDKVPVQQIELKMTHIKDVQVNYDYLTELVEKLLNEMHEEKIEAAQKTKKDIDQFANGLEDQNYAHKIKNATQAILDGYYPPKGMAMIYPVKLDDSEQVIQEANQISIDRILLEFRNQWGITDVITSAGLRQLFSTHQYGQQDLDDAGQLRDIIAEASLSYKNLALDTDIQALSKIRYRNGLREAIYLAADKHVIH

SEQ ID NO: 59 - DNA, 834 bp, Lactobacillus delbrueckii
ttggaatcaaacaataaagatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgatattagacaataccaacattgctggtgggaactcagtttatgaagttgtacaccaggttcagctacagaaaaagaccgtgcttaatcgagaccgtcgtttcgacgttagtttgttgatcaacggcttgccggtgattcacattgagcttaaagcgccaaatgttccttataagaaggcctttaaccaaattcaaaagtatatcgatgaagggcaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgctgaagaggtcttgtcaattcctgctgctcaccatatgattgccgactatgtggtcttagacagcgaaaacaagagcgttatcctgctccgtccttaccagatacacgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctactaataaatagtttagcaagtaaaaattag

SEQ ID NO: 60 - protein, 277 aa, Lactobacillus delbrueckii
MESNNKDQLNDHPLTPNEKMTVRTAIVKPTFYRATEFMVGANRQVRYHLRREDSSIPDADLLILDNTNIAGGNSVYEVVHQVQLQKKTVLNRDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSENKSVILLRPYQIHAIQAIFKASRESKSGYIWHTTGSGKTLTSYKVARNLLQIPSIDKSIFLLINSLASKN

SEQ ID NO: 61 - DNA, 3093 bp, Lactobacillus delbrueckii
atggcttttacggataaaacagagaagggctttgagacgataatcgtgaactggctcgtagagcagaacagctacgagcagggaacgaatgatgattacaacaaggaatacaccgtagacgaaacccgcctcttccggttcttaaatgacacgcagccaagggaaatggcaaagcttggtgtaaataacagcgatcagaagaagcggcagttcctaaaccgcctctccggagagattgccaagcgcggcatcattgatgttcttagaaacggcgtgaaggcctacccggctgatctcatcatgttctacttcacgcctactgagaacaatgagaagtcaaagcagatgtttgagaagaacatcttcagtgtgacacggcagcttcgctattccattgacgcttcgaagcttgcgctcgacctttgcctgttcatcaacggtcttccggtcattacgagtgagctcaagaatcatttcactggtcagtcaacagcagatgccgttgagcagtataaggaagatcgcgatccgcgggacacgctgttctcgtttaaacggtgcatggtgcattttgcggtagacgaccagaccatcatgttctgcacgaagcttgctggtaaagacagttggtttctgccattcaacaagggctataacgatggcgcgggcaatccgccgaacccgaacggcatcatgacagactatctgtggaaggacattctgacgaagtggaagctctcccgaattattgagaattacgctcaggtcgtcgctgatgaagatccggacacgaagaagaaaactgtgaaacagatctggccacgttaccatcagctggactgcgtggaaaagctgctcacagatgtgaaacaaaatggtgtcggtaagcgctatctcattcagcacagtgcaggctccggaaagtcgaattctatcgcatggcttgctcaccagctgatcggccttgagcaagatggccatccgatgatcgattccgtcatcgtcgtcacagaccgcagaattctggacaagcagatccgcgataccatcaagcagttcatgcaggtgaaaaacacggtcgtttgggcgcagcattccagagacctgaagaaggcaatccaggatggcaagcggatcattataactacggttgagaagttcccgtacatctcgcaggagatcgggcaggaacatatacataaccattttgccatcatcatcgatgaggcacactcaggccagagcggtcgcaattctgcgaatatgaatctggcactttccggcatggcttcagacaacgaaatggacaatgaggacaagatcaatgcgattgtcgagggccggaagcttgtaaagacggcaagttactttgcctttaccgcaactccgaagaataaaaccgaggaaattttcggcactccgtatgaagaagatggtgtaattaagcataggccgttccatgtttataccatgaagcaggcaattcaggaaggcttcattcttgatgtgcttaagaattacacgacgattgatagctggtacaagattgcgaaaaaggtcgaggatgatccgatgttcgacaaaaaacgtgcccagaagaagctgcgctcatttgtcgagggaaatccagatgtcattgcgaagaaagccgcaatgatggtagatcattttcatgagcagataattgcgaagaaaaagctgaatggaaaatcacgtgcaatggttgtgacagcaagcatcccgcgttgcatagaaacttattatgccattaataaatgccttgctgacaggcacagtccttacaaggctataattgcattctccggtgagtgcaagtacaacaaccaggaaccccctctgacttcagcggggttaaatggtttcccagacgcgaagatcccgaaagagttcaagaaagacccataccgtcttctcgtggttgctgatatgttccagacgggatttgatgagcctttgcttcaaacaatgtacgtagataagccactgtacgatattgcagcggttcaaacactatctcgtctgaatagggcggcaccgggcaaggatgaagtttatgtgctggattttgccaataagacttcgacgattgaagaagcgttctctaagttctacaggacaacaatattgtctggagagactgatccaaacaagctatatgacttgatatcaataatggaagaatatcaagtttatgacaaggatgatgttgagcatgtggttgacttgttcctgaaaggtgcagagagagatagacttgacccggtacttgatccatgcgttgttgtttacaatgagcttgagacagatgaccagatcaagttcaagagtgctgcgaaatcatttgtgaggacgtatggcttccttggttcaatccttccgtatggaaatgttgactgggagaagttatctatctttttaaatctgctgattccgaaactcccgtcaccacgagaggatgatttttcggagggtattctgtctacaattgacctggacagctatcggaatgaggctcaggaggctgtagccataaagctcgaagacgaagatgcggaaataggaccagttcctgccgggaaggtcggtcatattgtggaaccggaaatggatcctctgtcccagattatctctgacttcaacgactttttcggaaatatcaactggaatgatgcagacaatgtgaagagacagattctggaaatcccagtcatggtttcaaacgatgagaagtaccagaatgcaatgaaaaactctgacgagcaagaggcccgcacagagagtgaacgtgcattgcagaaggttatcttctcgattatggctgataacatggagctgtttaaacagtttcaagataatccttcattcaaaaagtggctcacaaatatggtcttcaacttgacatacaacaaggaaggcaaacaatttggggcacctgaagaaacttctacgttaagaactttgaaaggaaatccgcctaattacaaatattccattcatagttcaactacaacacagatggtggcggagcagcatcgaacattcggcgaaacaaagaataacgaaaaacggtaa

SEQ ID NO: 62 - protein, 1030 aa, Lactobacillus delbrueckii
MAFTDKTEKGFETIIVNWLVEQNSYEQGTNDDYNKEYTVDETRLFRFLNDTQPREMAKLGVNNSDQKKRQFLNRLSGEIAKRGIIDVLRNGVKAYPADLIMFYFTPTENNEKSKQMFEKNIFSVTRQLRYSIDASKLALDLCLFINGLPVITSELKNHFTGQSTADAVEQYKEDRDPRDTLFSFKRCMVHFAVDDQTIMFCTKLAGKDSWFLPFNKGYNDGAGNPPNPNGIMTDYLWKDILTKWKLSRIIENYAQVVADEDPDTKKKTVKQIWPRYHQLDCVEKLLTDVKQNGVGKRYLIQHSAGSGKSNSIAWLAHQLIGLEQDGHPMIDSVIVVTDRRILDKQIRDTIKQFMQVKNTVVWAQHSRDLKKAIQDGKRIIITTVEKFPYISQEIGQEHIHNHFAIIIDEAHSGQSGRNSANMNLALSGMASDNEMDNEDKINAIVEGRKLVKTASYFAFTATPKNKTEEIFGTPYEEDGVIKHRPFHVYTMKQAIQEGFILDVLKNYTTIDSWYKIAKKVEDDPMFDKKRAQKKLRSFVEGNPDVIAKKAAMMVDHFHEQIIAKKKLNGKSRAMVVTASIPRCIETYYAINKCLADRHSPYKAIIAFSGECKYNNQEPPLTSAGLNGFPDAKIPKEFKKDPYRLLVVADMFQTGFDEPLLQTMYVDKPLYDIAAVQTLSRLNRAAPGKDEVYVLDFANKTSTIEEAFSKFYRTTILSGETDPNKLYDLISIMEEYQVYDKDDVEHVVDLFLKGAERDRLDPVLDPCVVVYNELETDDQIKFKSAAKSFVRTYGFLGSILPYGNVDWEKLSIFLNLLIPKLPSPREDDFSEGILSTIDLDSYRNEAQEAVAIKLEDEDAEIGPVPAGKVGHIVEPEMDPLSQIISDFNDFFGNINWNDADNVKRQILEIPVMVSNDEKYQNAMKNSDEQEARTESERALQKVIFSIMADNMELFKQFQDNPSFKKWLTNMVFNLTYNKEGKQFGAPEETSTLRTLKGNPPNYKYSIHSSTTTQMVAEQHRTFGETKNNEKR

SEQ ID NO: 63 - DNA, 3021 bp, Lactobacillus delbrueckii
atgactttagaatcacaactggaagacgacctaatcgcgcagttgacgcaggatgtccatcagtggaagttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgatattagacaataccaacattgctggtgggaactcagtttatgaagttgtacaccaggttcagctacagaaaaagaccgtgcttaatcgagaccgtcgtttcgacgttagtttgttgatcaacggcttgccggtgattcacattgagcttaaagcgccaaatgttccttataagaaggcctttaaccaaattcaaaagtatatcgatgaagggcaatttactgacatttacagcttcgtagaaatgtttgtggtaactaatggtactcaaacaagatatatatctgctgggaagaatttgaatgccaagtttttaacggcctgggttgataagaataataagcgggtagacaattatctgagttttgctgaagaggtcttgtcaattcctgctgctcaccatatgattgccgactatgtggtcttagacagcgaaaacaagagcgttatcctgctccgtccttaccagatacacgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctaatcgaccgtaaagacctggacatgcagactacaactgcttttaagatttacgccaacaacgatacgatcagcgttaacgaaacaaatagcagttatgaccttgctgaccagctgactgatggcgaccggactgtagtagttactacccgccagaagatgcaaaacatgtttaagcggattgatgaattggatcagttgcctaaacggtatgagaatttaaagaatatgcggctagccttcatcgtcgatgaatgtcacagaacgattacccctagccaaaagcgggagattgataaattctttaaccgcaaaccgctgtggtatggctttactggtacgccaatttttaacgagaatgcccgggcaaagaatggtcaagacgcgcggacgactgaagaattatatgggccagtcctgcacaagtatacgatcggggatgcaattagagacaagatggttttgggcttctccatcgataatcaaggtggcagcaacgaggatggaaatgaagaagataccaagaaaatggataagatttaccggtccaaggcccatatgcattcagttgcgacagcagtaattaaagcggcgtaccgcaagcagggccttatttctggtaagaaatactcagccattttgacgacttcgtcaattgagaaagcccagaagtactaccgtatctttaagaaaatcatcgatggggaagacgaggaattcaagattccggaacgaatcaagaaagtggcaccagacttcccaaagatcgctattacttactcagttagtgaaaacgaagatgattcagaatcagtgcaagacgagatgaagcagtcgcttgcggactacaacgccgtttatggaacgaacttctcaatggctgagctggatcagtacaatcaaaacgttaatgcccggctggcccgcaagaaggctcaataccaagctgacaaccaacgcttagacctagtgatagttgttaaccgtttgttgactggctttgactcaccaagtttgtcgactttgtacattgaccggccaccaatgagtccgcaggacatgattcaggctttttctagaaccaaccggatttttgataaagacaagacttggggacaaatcgtaacttaccagtatccaaagacctttagtgaaaagatcgatgacgcaatcgtcctatattctaatggcggggagaagtatgcggttgctccaagctgggaagaatcaaaacaaagctacatatcagcccggtctaaaattgacatgtacagcttcgacgcagatggaccgtcaatttatgatgcttccaaggaagaaaagaagaaattcgttaaagctttccaagaatttgacaaggctttggccgcaatcaagacctatgatgaattagataccgaagaaggcctaatgcaattaggtgtgagtgacattacaccagatgattgggaagccatgcggggagtttatgaggatattctggacgatctgcggaaagatccagatgaagatcctgatcacaatgacgacatcgatgatgaatacgaacttgagtcatttggacaaaaggaaatcgatgagcgctatatcatgaatttgatccaggcgttcttgccagaaagttctgacaatcaagaaaaagctagtggcaatgaaatctcgccagaaactgtcgaggaaatcaatggctacattgatgaactggcgaagacaaacgaacttttggcagaaatcatgcgtaagctttggcagcagattttgcaggacccggctaaatacgcaggcaagcaggttgatgagctccttgaatccttgattgaccaggaattgcaatcaatcatgcgtgagtttgctgataagtacaaggttgactacgaccagttccggtacgttatggctaactatgaccctaagttaaagggaaataagcaaaaggggatgaacgaccttttgcacaaggaacgttttgtcgactacttgaatgacaatccggattctgacttaaataagccgtaccgctggaagagtgaagttcgggaacaggccaagcaatactatgtcgataagattggcccgttaattaacagagaagcatag

SEQ ID NO: 64 - protein, 1006 aa, Lactobacillus delbrueckii
MTLESQLEDDLIAQLTQDVHQWKFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTVLNRDRRFDVSLLINGLPVIHIELKAPNVPYKKAFNQIQKYIDEGQFTDIYSFVEMFVVTNGTQTRYISAGKNLNAKFLTAWVDKNNKRVDNYLSFAEEVLSIPAAHHMIADYVVLDSENKSVILLRPYQIHAIQAIFKASRESKSGYIWHTTGSGKTLTSYKVARNLLQIPSIDKSIFLIDRKDLDMQTTTAFKIYANNDTISVNETNSSYDLADQLTDGDRTVVVTTRQKMQNMFKRIDELDQLPKRYENLKNMRLAFIVDECHRTITPSQKREIDKFFNRKPLWYGFTGTPIFNENARAKNGQDARTTEELYGPVLHKYTIGDAIRDKMVLGFSIDNQGGSNEDGNEEDTKKMDKIYRSKAHMHSVATAVIKAAYRKQGLISGKKYSAILTTSSIEKAQKYYRIFKKIIDGEDEEFKIPERIKKVAPDFPKIAITYSVSENEDDSESVQDEMKQSLADYNAVYGTNFSMAELDQYNQNVNARLARKKAQYQADNQRLDLVIVVNRLLTGFDSPSLSTLYIDRPPMSPQDMIQAFSRTNRIFDKDKTWGQIVTYQYPKTFSEKIDDAIVLYSNGGEKYAVAPSWEESKQSYISARSKIDMYSFDADGPSIYDASKEEKKKFVKAFQEFDKALAAIKTYDELDTEEGLMQLGVSDITPDDWEAMRGVYEDILDDLRKDPDEDPDHNDDIDDEYELESFGQKEIDERYIMNLIQAFLPESSDNQEKASGNEISPETVEEINGYIDELAKTNELLAEIMRKLWQQILQDPAKYAGKQVDELLESLIDQELQSIMREFADKYKVDYDQFRYVMANYDPKLKGNKQKGMNDLLHKERFVDYLNDNPDSDLNKPYRWKSEVREQAKQYYVDKIGPLINREA

SEQ ID NO: 65 - DNA, 957 bp, Lactobacillus delbrueckii
atgactttagaatcacaactggaagacgacctaatcgcgcagttgacgcaggatgtccatcagtggacgttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgatattagacaataccaacattgctggtgggaactcagtttatgaagttgtgcaccaggttcagctacagaaaaagaccgtgcttaatcgagaccgtcgtttcgacgttagtttgttgatcaacggcttgccggtgattcacattgagcttaaagcgccgaatgttccttataagaaggcctttaaccaaattcaaaagtatatcgatgaagggcaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgctgaagaggtcttgtcaattcctgctgctcaccatatgattgccgactatgtggtcttagacagcgaaaacaagagcgttatcctgctccgtccttaccagatacacgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctactaataaatagtttagcaagtaaaaattag

SEQ ID NO: 66 - protein, 318 aa, Lactobacillus delbrueckii
MTLESQLEDDLIAQLTQDVHQWTFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTVLNRDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSENKSVILLRPYQIHAIQAIFKASRESKSGYIWHTTGSGKTLTSYKVARNLLQIPSIDKSIFLLINSLASKN

SEQ ID NO: 67 - DNA, 465 bp, Lactobacillus delbrueckii
gatttgctgattttagacaataccaacattgcgggtggaaactcagtttatgaagttgtacaccaggttcagctacagaagaagaccgcgcttaatcaagaccgtcgtttcgacgttagtttgttgatcaacggcttgccggtaattcacattgagcttaaagctccaaatgttccttataagaaggcctttaaccaaattcaaaagtatatcgacgaaggacaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgcagaagaggttttgtcaatacctgctgctcaccatatgattgccgactatgtggttttagacagcgaaagcaagagcgttatcctgctc

SEQ ID NO: 68 - protein, 155 aa, Lactobacillus delbrueckii
DLLILDNTNIAGGNSVYEVVHQVQLQKKTALNQDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSESKSVILL

SEQ ID NO: 69 - DNA, 3021 bp, Lactobacillus delbrueckii
atgactttagaatcacaactggaagacaacctaatcgcgcagttgacgcaggatgtccatcagtggaagttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgattttagacaataccaacattgcgggtggaaactcagtttatgaagttgtacaccaggttcagctacagaagaagaccgcgcttaatcaagaccgtcgtttcgacgttagtttgttgatcaacggcttgccggtaattcacattgagcttaaagctccaaatgtttcttataagaaggcctttaaccaaattcaaaagtatatcgacgaaggacaatttactgacatttacagcttcgtagaaatgtttgtggtaactaatggtgctcaaacaagatatatatctgctgggcagaatttgaatgccaagtttttaacggcctgggttgataagaataataagcgggtagacaattatctgagttttgcagaagaggttttgtcaatacctgctgctcaccatatgattgccgactatgtggttttagacagcgaaagcaagagcgttatcctgctccgtccttaccagatacatgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctaatcgaccgtaaagacctggacacgcagactacaactgctttcaagatttacgccaacaacgatacgatcagcgttaacgaaacaaataatagttatgaccttgctgaccagatgactgatggcgaccggactgtagtagttactacccgccagaagattcaaaacatgtttaagcggattgatgaattggatcagttgcctaaacggtatgagaacttaaagaatatgcggctggccttcatcgtcgatgaatgtcacagaacgattacccctagccaaaagcgggagattgataaattctttaaccgcaaaccgctgtggtatggctttactggtacgccaatttttaacgagaatgcccgggcaaagaatggtcaagacgcgcggacgactgaagaattatatgggccagtcctgcacaagtatacgatcggggatgcaattagagacaagatggttttgggcttctccatcgataatcaaggtggcagcaacgaggatggaaatgaagaagataccaagaaaatggatcagatttaccggtccaaggcccatatgcattcagttgcgacagcagtaattaaagcggcgtaccgcaagcagggccttatttctggtaagaaatactcagccatttttacgacttcgtcaattgagcaagcccagaagtactaccgtatctttaagaaaatcatcgatggggaagacgaggaattcaagattccggaacgaatcaagaaagtggcaccagacttcccaaagatcgctattacttactcagttagtgaaaacgaagatgattcagaatcagtgcaagatgagatgaagcagtcgcttgcggactacaacgccgtttatgggacgaacttctcgatggctgagctggatcagtacaatcaaaacgttaatgcccggcttgcccgcaagaaggctcaataccaagctgacaaccaacgcttagacctagtgatagttgttaaccgtttgctgactggttttgactcaccaagtttgtcgactttgtacattgaccggccgccaatgagtccacaggacattatccaggctttttctagaaccaaccggatttttgataaagacaagacttggggacaaatcgtaacttaccagtatcccaagacctttagtgaaaagattgatgatgcgatcgtcctatattctaatggtggggagaagtatgcggttgctccaagctgggaagaatcaaaacaaagctacatatcagcccggtctaaaattgaaatgtacagcttcgacgcagatggaccgtcaatttatgatgcttctaaggaagaaaagaagaaattcgttaaagcttttcaagaatttgacaaggctttggctgcaatcaagacctatgatgaattagataccgaagaaggcctaatgcaattaggtgtgagcgacattacaccagatgattgggaagccatgcggggagtttatgaggatattctggacgatctgcggaaagatccagatgaagatcctgatcacaatgacgacatcgatgatgaatacgaacttgagtcatttggacaaaaggaaatcgatgagcgctatatcatgaatttgatccaggcgttcttgccagaaagttctgacaatcaagaaaaagctagtggcaatgaaatctcgccagaaactgtcaaggaaatcaatggctacattgatgaactggcgaagacaaacgaacttttggcagaaatcatgcgtaagctttggcaacagattttgcaggacccggctaaatacgcaggcaagcaggttgatgagctccttgaatccttgattgaccaggaattgcaatcaatcatgcgtgagtttgctgataagtacaaggttgactacgaccagttccgctacgttatggctaactatgaccctaagttaaagggaaataagcaaaaggggatgaacgaccttttgcacaaggaacgttttgtcgactacttgaatgacaatccggattctgacttaaataagccgtaccgctggaagagtgaagttcgggaacaggccaagcaatactatgtcgataagattggcccgttaattaacagagaagcatag

SEQ ID NO: 70 - protein, 1006 aa, Lactobacillus delbrueckii
MTLESQLEDNLIAQLTQDVHQWKFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTALNQDRRFDVSLLINGLPVIHIELKAPNVSYKKAFNQIQKYIDEGQFTDIYSFVEMFVVTNGAQTRYISAGQNLNAKFLTAWVDKNNKRVDNYLSFAEEVLSIPAAHHMIADYVVLDSESKSVILLRPYQIHAIQAIFKASRESKSGYIWHTTGSGKTLTSYKVARNLLQIPSIDKSIFLIDRKDLDTQTTTAFKIYANNDTISVNETNNSYDLADQMTDGDRTVVVTTRQKIQNMFKRIDELDQLPKRYENLKNMRLAFIVDECHRTITPSQKREIDKFFNRKPLWYGFTGTPIFNENARAKNGQDARTTEELYGPVLHKYTIGDAIRDKMVLGFSIDNQGGSNEDGNEEDTKKMDQIYRSKAHMHSVATAVIKAAYRKQGLISGKKYSAIFTTSSIEQAQKYYRIFKKIIDGEDEEFKIPERIKKVAPDFPKIAITYSVSENEDDSESVQDEMKQSLADYNAVYGTNFSMAELDQYNQNVNARLARKKAQYQADNQRLDLVIVVNRLLTGFDSPSLSTLYIDRPPMSPQDIIQAFSRTNRIFDKDKTWGQIVTYQYPKTFSEKIDDAIVLYSNGGEKYAVAPSWEESKQSYISARSKIEMYSFDADGPSIYDASKEEKKKFVKAFQEFDKALAAIKTYDELDTEEGLMQLGVSDITPDDWEAMRGVYEDILDDLRKDPDEDPDHNDDIDDEYELESFGQKEIDERYIMNLIQAFLPESSDNQEKASGNEISPETVKEINGYIDELAKTNELLAEIMRKLWQQILQDPAKYAGKQVDELLESLIDQELQSIMREFADKYKVDYDQFRYVMANYDPKLKGNKQKGMNDLLHKERFVDYLNDNPDSDLNKPYRWKSEVREQAKQYYVDKIGPLINREA

SEQ ID NO: 71 - DNA, 3021 bp, Lactobacillus delbrueckii
atgactttagaatcacaactggaagacaacctaatcgcgcagttgacgcaggatgtccatcagtggaagttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgattttagacaataccaacattgcgggtggaaactcagtttatgaagttgtacaccaggttcagctacagaagaagaccgcgcttaatcaagaccgtcgtttcgacgttagtttgttgatcaacggcttgccggtaattcacattgagcttaaagctccaaatgttccttataagaaggcctttaaccaaattcaaaagtatatcgacgaaggacaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgcagaagaggttttgtcaatacctgctgctcaccatatgattgccgactatgtggttttagacagcgaaagcaagagcgttatcctgctccgtccttaccagatacatgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctaatcgaccgtaaagacctggacacgcagactacaactgctttcaagatttacgccaacaacgatacgatcagcgttaacgaaacaaataatagttatgaccttgctgaccagctgactgatggcgaccggactgtagtagttactacccgccagaagatgcaaaacatgtttaagcggattgatgaattagatcagttgcctaaacggtatgagaatttaaagaatatgcggctagccttcatcgtcgatgaatgtcacagaacgattacccctagccaaaagcgggagattgataaattctttagccgcaaaccgctgtggtatggctttactggtacgccaatttttaacgagaatgcccgggcaaagaatggtcaagacgcgcggacgactgaagaattatatgggccagtcctgcacaagtatacgatcggggatgcaattagagacaagatggttttgggcttctccatcgataatcaaggtggcagcaacgaagatgggaatgaagaagacaccaagaaaatggaccagatttaccggtccaaggcccatatgcattcagttgcgacggcagtaattaaagcggcgtaccgcaagcagggccttatttctggtaagaaatactcagccattttgacgacttcgtcaattgagcaagcccagaagtactaccgtatctttaagaaaatcatcgatggggaagacgaagaattcaagattccggaacgaatcaagaaagtggcaccagacttcccaaagatcgctattacttactcagttagtgaaaacgaagatgattcagaatcagtgcaagatgagatgaagcagtcgcttgcggactacaacgccgtttatgggacgaacttctcgatggctgagctggatcagtacaatcaaaacgttaatgcccggcttgcccgcaagaaggctcaataccaagctgacaaccaacgcttagacctagtgatagttgttaaccgtttgctgactggttttgactcaccaagtttgtcgactttgtacattgaccggccgccaatgagtccacaggacattatccaggctttttctagaaccaaccggatttttgataaagacaagacttggggacaaatcgtaacttaccagtatcccaagacctttagtgaaaagattgatgatgcaatcgtcctatattctaatggcggggagaagtatgcggttgctccaagctgggaagaatcaaaacaaagctacatatcagcccggtctaaaattgaaatgtacagcttcgacgcagatggaccgtcaatttatgatgcttccaaggaagaaaagaagaaattcgttaaagctttccaagaatttgacaaggctttggctgcaatcaagacctatgatgaattagataccgaagaaggcctaatgcaattaggtgtgagcgacattacaccagatgattgggaagccatgcggggagtttatgaggatattctggacgatctgcggaaagatccagatgaagatcctgatcacaatgacgacatcgatgatgaatacgaacttgagtcatttggacaaaaggaaatcgatgagcgctatatcatgaacttgatccaggcattcttgccagagagctctaacaatcaagaagaagctagcagcaatgaaatttcgcctgagacagtcaaggaaatcaatggccacattgatgaattggcgaagacaaacgagcttttggcagagattatgcggaagctctggcagcagattttgcaggatccggctaaatacgctggcaagcaggtcgatgagctccttgaatccttgattgaccaggaattgcaatcaatcatgcgtgagtttgctgataaatacaaggttgactacgaccagttccggtacgttatggctaactatgaccctaagttaaagggaaataagcaaaaggggatgaatgaccttttggacaaggaacgttttgtcgactacttgaatgacaatccggattctgacttaaataagccgtaccgctggaagagtgaagttcgggaacaggccaagcaatactatgtcgataagattggcccgttaattaacagagaagcatag

SEQ ID NO: 72 - protein, 1006 aa, Lactobacillus delbrueckii
MTLESQLEDNLIAQLTQDVHQWKFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTALNQDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSESKSVILLRPYQIHAIQAIFKASRESKSGYIWHTTGSGKTLTSYKVARNLLQIPSIDKSIFLIDRKDLDTQTTTAFKIYANNDTISVNETNNSYDLADQLTDGDRTVVVTTRQKMQNMFKRIDELDQLPKRYENLKNMRLAFIVDECHRTITPSQKREIDKFFSRKPLWYGFTGTPIFNENARAKNGQDARTTEELYGPVLHKYTIGDAIRDKMVLGFSIDNQGGSNEDGNEEDTKKMDQIYRSKAHMHSVATAVIKAAYRKQGLISGKKYSAILTTSSIEQAQKYYRIFKKIIDGEDEEFKIPERIKKVAPDFPKIAITYSVSENEDDSESVQDEMKQSLADYNAVYGTNFSMAELDQYNQNVNARLARKKAQYQADNQRLDLVIVVNRLLTGFDSPSLSTLYIDRPPMSPQDIIQAFSRTNRIFDKDKTWGQIVTYQYPKTFSEKIDDAIVLYSNGGEKYAVAPSWEESKQSYISARSKIEMYSFDADGPSIYDASKEEKKKFVKAFQEFDKALAAIKTYDELDTEEGLMQLGVSDITPDDWEAMRGVYEDILDDLRKDPDEDPDHNDDIDDEYELESFGQKEIDERYIMNLIQAFLPESSNNQEEASSNEISPETVKEINGHIDELAKTNELLAEIMRKLWQQILQDPAKYAGKQVDELLESLIDQELQSIMREFADKYKVDYDQFRYVMANYDPKLKGNKQKGMNDLLDKERFVDYLNDNPDSDLNKPYRWKSEVREQAKQYYVDKIGPLINREA

SEQ ID NO: 73 - DNA, 957 bp, Lactobacillus delbrueckii
atgactttagaatcacaactggaagacgacctaatcgcgcagttgacgcaagatgtccatcagtggaagttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggctaaccggcaggttcgctatcacttaagaagagaagattcttctattcccgacgctgatctgctgatattagacaataccaacattgctggtgggaactcagtttatgaagttgtacaccaggttcagctacagaaaaagaccgcgcttaatcaagaccgtcgtttcgacgttagtttgttgatcaacggcttgccggtgattcacattgagcttaaagcgccaaatgttccatataagaaggcctttaaccaaattcaaaagtatatcgatgaagggcaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgctgaagaggtcttgtcaattcctgctgctcaccatatgattgccgactatgtggtcttagacagcgaaaacaagagcgttatcctgctccgtccttaccagatacacgcgattcaagcgatttttaaggcttctagagagagtaagtcgggctatatttggcatacgacagggtcaggcaagacgttaacttcgtacaaggttgcccgtaacttgttgcaaattccgtcaattgataagtcaatcttcctactaataaatagtttagcaagtaaaaattag

SEQ ID NO: 74 - protein, 318 aa, Lactobacillus delbrueckii
MTLESQLEDDLIAQLTQDVHQWKFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTALNQDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSENKSVILLRPYQIHAIQAIFKASRESKSGYIWHTTGSGKTLTSYKVARNLLQIPSIDKSIFLLINSLASKN

SEQ ID NO: 75 - DNA, 957 bp, Lactobacillus delbrueckii; identical to SEQ ID NO: 73

SEQ ID NO: 76 - protein, 318 aa, Lactobacillus delbrueckii; identical to SEQ ID NO: 74

SEQ ID NO: 77 - DNA, 3021 bp, Lactobacillus delbrueckii
atgactttagaatcacaactggaagacgacctaatcgcgcagttgacgcaggatgtccatcagtggaagttccgttatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatttgctgatattagacaataccaacattgctggtgggaactcagtttatgaagttgtacaccaggttcagctacagaaaaagaccgcgcttaatcgagaccgtcgttttgacgttagtttgttgatcaacggcttgccggtgattcacattgagcttaaagcgccaaatgttccttataggaaggcctttaaccaaattcaaaagtatatcgatgaagggcaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgctgaagaggtcttgtcaattcctgctgctcaccatatgattgccgactatgtggtcttagacagcgaaaacaagagcgttatcctgctccgtccttaccagatacacgcgattcaagcgatttttaaggcttctagagagagtaagtcgggctatatttggcatacgacagggtcaggtaagacgttaacatcgtacaaggttgcccgtaacttgttgcaaattccgtcaattgataagtcaatcttcctaatcgaccgcaaagacctggacatgcagactacaactgctttcaagatttacgccaacaacgatacgatcagcgttaacgaaacaaatagcagttatgaccttgctgaccagctgactgatggcgaccggactgtagtagttactacccgccagaagatgcaaaacatgtttaagcggattgatgaattggatcagttgcctaaacggtacgagaatttaaagaatatgcggctagccttcatcgtcgatgaatgtcacagaacgattacccctagccaaaagcgggagattgataaattctttaaccgcaaaccgctgtggtatggctttactggtacgccaatttttaacgagaatgcccgggcaaagaatggtcaagacgcgcggacgactgaagaattatatgggccagtcctgcacaagtatacgatcggggatgcaattagagacaagatggttttgggcttctccatcgataatcaaggtggcagcaacgaggatggaaatgaagaagataccaagaaaatggataagatttaccggtccaaggcccatatgcattcagttgcgacagcagtaattaaagcggcgtaccgcaagcagggccttatttctggtaagaaatactcagccattttgacgacttcgtcaattgagaaagcccagaagtactaccgtatctttaagaaaatcatcgatggggaagacgaggaattcaagattccggaacgaatcaagaaagtggcaccagacttcccaaagatcgctattacttactcagttagtgaaaacgaagatgattcagaatcagtgcaagacgagatgaagcagtcgcttgcggactacaacgccgtttatggaacgaacttctcaatggctgagctggatcagtacaatcaaaacgttaatgcccggctggcccgcaagaaggctcaataccaagctgacaaccaacgcttagacctagtgatagttgttaaccgtttgttgactggctttgactcaccaagtttgtcgactttgtacattgaccggccaccaatgagtccacaggacatgatccaggctttttctagaaccaaccggatttttgataaagacaagacttggggacaaatcgtaacttaccagtatcccaagacctttagtgaaaagatcgatgacgcaatcgtcttgtattctaatggcggggagaagtatgcggttgctccaagctgggaagaatcaaaacaaagctacgtatcagcccggtctaaaattgacatgtacagcttcgacgcagatggaccgtcaatttatgatgcttccaaggaagaaaagaagaaattcgttaaagctttccaagaatttgacaaggctttggctgcaatcaagacctatgatgaattagataccgaagaaggcctaatgcaattaggtgtgagtgacattacaccagatgattgggaagccatgcggggagtttatgaggatattctggacgatctgcggaaagatccagatgaagatcctgatcacaatgacgacatcgatgatgaatacgaacttgagtcatttggacaaaaggaaatcgatgagcgctatatcatgaatttgatccaggcgttcttgccagaaagttctgacaatcaagaaaaagctagtggcaatgaaatctcgccagaaactgtcaaggaaatcaatggctacattgatgaactggcgaagacaaacgaacttttggcagaaatcatgcgtaagctttggcagcagattttgcaggacccggctaaatacgcaggcaagcaggttgatgagctccttgaatccttaattgaccaggaattgcaatcaatcatgcgtgagtttgctgataagtacaaggttgactacgaccagttccggtacgttatggctaactatgaccctaagttaaagggaaataagcaaaaggggatgaacgaccttttgcacaaggaacgttttgtcgactacttgaatgacaatccggattctgacttaaataagccgtaccgttggaagagtgaagttcgggaacaggccaagcaatactatgtagataagattggcccgttaattaacagagaagcatag

SEQ ID NO: 78 - protein, 1006 aa, Lactobacillus delbrueckii
MTLESQLEDDLIAQLTQDVHQWKFRYDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTALNRDRRFDVSLLINGLPVIHIELKAPNVPYRKAFNQIQKYIDEGQFTDIYSFVEMFVVTNGTQTRYISAGQNLNAKFLTAWVDKNNKRVDNYLSFAEEVLSIPAAHHMIADYVVLDSENKSVILLRPYQIHAIQAIFKASRESKSGYIWHTTGSGKTLTSYKVARNLLQIPSIDKSIFLIDRKDLDMQTTTAFKIYANNDTISVNETNSSYDLADQLTDGDRTVVVTTRQKMQNMFKRIDELDQLPKRYENLKNMRLAFIVDECHRTITPSQKREIDKFFNRKPLWYGFTGTPIFNENARAKNGQDARTTEELYGPVLHKYTIGDAIRDKMVLGFSIDNQGGSNEDGNEEDTKKMDKIYRSKAHMHSVATAVIKAAYRKQGLISGKKYSAILTTSSIEKAQKYYRIFKKIIDGEDEEFKIPERIKKVAPDFPKIAITYSVSENEDDSESVQDEMKQSLADYNAVYGTNFSMAELDQYNQNVNARLARKKAQYQADNQRLDLVIVVNRLLTGFDSPSLSTLYIDRPPMSPQDMIQAFSRTNRIFDKDKTWGQIVTYQYPKTFSEKIDDAIVLYSNGGEKYAVAPSWEESKQSYVSARSKIDMYSFDADGPSIYDASKEEKKKFVKAFQEFDKALAAIKTYDELDTEEGLMQLGVSDITPDDWEAMRGVYEDILDDLRKDPDEDPDHNDDIDDEYELESFGQKEIDERYIMNLIQAFLPESSDNQEKASGNEISPETVKEINGYIDELAKTNELLAEIMRKLWQQILQDPAKYAGKQVDELLESLIDQELQSIMREFADKYKVDYDQFRYVMANYDPKLKGNKQKGMNDLLHKERFVDYLNDNPDSDLNKPYRWKSEVREQAKQYYVDKIGPLINREA

SEQ ID NO: 79 - DNA, 2307 bp, Lactobacillus delbrueckii
atgatgaccgataaaatgtcaatgagcgaagaagacatcaaaaatcagtttatttcccctgcggttttcgatgtggcaggatggttgaagtctgatgcgcgcatggaatatagctatactgatggccggattaatgtgattgatgacaagccaagacgcggtaagcgaaagtctgtagactatttactcttttataagccaaacttccccattgcggtaattgaagctaaagaccgtaaaaaacatgcagatcctggagcaggtttacaacaagggatagactatgcaaaagatttaaacgttccttttgtttatgcatcaaatggggatgcctttgttgaacatgacttaattacagggaaggagcagagattagatctagatagttttccgaagaaagaggagctttggaaacgatataaagaagagtcaggtttaacgccagctcaagagaaagttatctctgaaccttactattcttcaagaacatcattagagccacgctactatcaacgaattgcaatcaatagaacagttgaagcagtggcaaatggcagaaataaaattttgctagttatggcgacagggaccgggaaaacctatacggcattccaaattgtctggcgtttgcttaaatctggtgttaagaaacatattttgtatttagcagatcgaaatgtactagttgatcaggcaatgagtggcgattttgggccgttgctcaataaagaaagtaaggttgttggtggtaagctggatagctcatatccaatcttatttgcgttatatcatcaactcgctggtagagaaggtgatgatggacatgaaccatttcggcagctaaaggctgacttctttgacctaattattgttgatgaagcccaccgagggtcagcaaaagaaaatagtcgttggcgtaaaattctagaatattttgatggcccaaatgtaactcagattgggatgaccgctacacctaaaaacgattcagaagcatccaaccttgattattttggtgaacctatctatacatattctctaaagcaagggattgaagatggattcttagctccatataaagtaatccgggttaatttagatgtggatgtcaataagtatcgtcctaagaagaatcaaaaagatgcgaatggccgattaataccagacaaggaatatacaagtagagactttgatagaactttagttattgatgatcgaactaaacaagtagcgcattattttagtgattaccttaagaagaataattgccgttttgataagagcattattttttgtgaggacattgaacacgctgaacgcatgcgccaagccttagtaaatgaaaatagtgacctttgcaaagaggattctcgatacgtaatgagaattactggggatgataaagtaggtaaggcccaaattagtaatttccaagatattcagagcaagtatccaactctagttactacttcaaaattattaacaactggtgttaatgttaagacgtgcaaatttattgttttagattcaaatatcaattcgatgactgattttaagcaaattattggacgtggcacacgcatcgctgaagagtatggtaaaagctattttacgattgttgactttagaggcgtgtctaggctgtttgcggatcctgcctttgatggtgaaccattagaagttgtagaatctaaaccaaattctggtggttcaggaggcaaaggcagtaatattggggaaccagacccaaaatattttgttaaggatcaaaaagttaaggtattgagtgatcatgttcagtaccttaatgcgagtgggaagctaatcacaacctcacttactgactacacaaagactaatgtgttgaataaattcgcaactctcgatgaattcttggctacctggaaaactaccgacaagaagcaagagttactagatgagttagaagagaatggtatttattacaaggacttagtaaaagatccaaaatatcaaaatatggatccctttgatctgttgctttaccttgcatacaatcaaaaaccaatgaccaaggcagaacgaataaagaatgtaaagaagtccggtctattggatcaataccaaggtgcagcaagagaagttctagaaactttgcttgaaaaatacaaaaatgatggcatttctgatgttgaggatatcaatgtcttgaacttgccagaatttgaaaaatttggcggtcctgtcaagattatctttactttatttggtggtaaggataagtatcaaaagaccattaaacagatggaagaaaaaatctatagttag

SEQ ID NO: 80 - protein, 768 aa, Lactobacillus delbrueckii
MMTDKMSMSEEDIKNQFISPAVFDVAGWLKSDARMEYSYTDGRINVIDDKPRRGKRKSVDYLLFYKPNFPIAVIEAKDRKKHADPGAGLQQGIDYAKDLNVPFVYASNGDAFVEHDLITGKEQRLDLDSFPKKEELWKRYKEESGLTPAQEKVISEPYYSSRTSLEPRYYQRIAINRTVEAVANGRNKILLVMATGTGKTYTAFQIVWRLLKSGVKKHILYLADRNVLVDQAMSGDFGPLLNKESKVVGGKLDSSYPILFALYHQLAGREGDDGHEPFRQLKADFFDLIIVDEAHRGSAKENSRWRKILEYFDGPNVTQIGMTATPKNDSEASNLDYFGEPIYTYSLKQGIEDGFLAPYKVIRVNLDVDVNKYRPKKNQKDANGRLIPDKEYTSRDFDRTLVIDDRTKQVAHYFSDYLKKNNCRFDKSIIFCEDIEHAERMRQALVNENSDLCKEDSRYVMRITGDDKVGKAQISNFQDIQSKYPTLVTTSKLLTTGVNVKTCKFIVLDSNINSMTDFKQIIGRGTRIAEEYGKSYFTIVDFRGVSRLFADPAFDGEPLEVVESKPNSGGSGGKGSNIGEPDPKYFVKDQKVKVLSDHVQYLNASGKLITTSLTDYTKTNVLNKFATLDEFLATWKTTDKKQELLDELEENGIYYKDLVKDPKYQNMDPFDLLLYLAYNQKPMTKAERIKNVKKSGLLDQYQGAAREVLETLLEKYKNDGISDVEDINVLNLPEFEKFGGPVKIIFTLFGGKDKYQKTIKQMEEKIYS

SEQ ID NO: 81 - DNA, 3021 bp, Lactobacillus delbrueckii
atgactttagaatcacaactggaagacaacctaatcgcgcagttgacgcaggatgtccatcagtggaagttccgtgatgatttacgcaccgtagatcagctttgggacaactttttccgtatcttggaatcaaacaataaggatcagttaaatgaccatccgttgactcctaacgaaaaaatgacggtgagaacggcgatcgttaaaccgaccttttaccgggcaacggagtttatggtcggggccaaccggcaggttcgctatcacttaagaagagaagattcttctattcccgacgctgatctgctgattttagacaataccaacattgcgggtggaaactcagtttatgaagttgtacaccaggttcagctacagaagaagaccgcgcttaatcaagaccgtcgtttcgacgttagtttgttgatcaacggcttgccggtaattcacattgagcttaaagctccaaatgttccttataagaaggcctttaaccaaattcaaaagtatatcgacgaaggacaatttactgacatttacagcttcgtagaaatgtttgtggtaactaatggtactcaaacaagatatatatctgctgggcagaatttgaatgccaagtttttaacggcctgggttgataagaataataagcgggtagacaattatctgagttttgcagaagaggttttgtcaatacctgctgctcaccatatgattgccgactatgtggttttagacagcgaaagcaagagcgttatcctgctccgtccttaccagatacatgcgattcaagcgatttttaaggcttctagagagagtaagtcgggctatatttggcatacgacagggtcaggtaagacgttaacttcgtacaaggttgcccgtaacttgttgcaaattccgtcaattgataagtcaatcttcctaatcgaccgtaaagacctggacacgcagactacaactgctttcaagatttacgccaacaacgatacgatcagcgttaacgaaacaaataatagttatgaccttgctgaccagatgactgatggcgaccggactgtagtagttactacccgccagaagatgcaaaacatgtttaagcggattgatgaattagatcagttgcctaaacggtatgagaatttaaagaatatgcggctagccttcatcgtcgatgaatgtcacagaacgattacccctagccaaaagcgggagattgataaattctttaaccgcaaaccgctgtggtacggcttcactggcacaccaattttcaacgagaatgcccgggcaaagaatggtcaagacgcgcggacgactgaagaattatatgggccagtcctgcacaagtatacgatcggggatgcaattagagataagatggttttgggcttctccatcgataatcaaggtggcagcaatgaagatggaaatgaagaagataccaagaaaatggaccagatttaccggtccaaggcccatatgcattcagttgcgacggcagtaattaaagcggcgtaccgcaagcagggccttatttctggtaagaaatactcagccattttgacgacttcgtcaattgagcaagcccagaagtactaccgtatctttaagaaaatcatagatggggaagacgaagaattcaagattccggaacgaatcaagaaagtggcaccagacttcccaaagatcgctattacttactcagttagtgaaaacgaagatgattcagaatcagtgcaagacgagatgaagcagtcgcttgcggactacaacgccgtttatggaacgaacttctcaatggctgagctggatcagtacaatcaaaacgttaatgcccggcttgcccgcaagaaggctcaataccaagctgacaaccaacgcttagacctagtgatagttgttaaccgtttgctgactggttttgactcaccaagtttgtcgactttgtacattgaccggccgccaatgagtccacaggacattatccaggctttttctagaaccaaccggatttttgataaagacaagacttggggacaaatcgtaacttaccagtatcccaagacctttagtgaaaagatcgatgacgcaatcgtcctatattctaatggcggggagaagtatgcggttgctccaagctgggaagaatcaaaacaaagctacatatcagcccggtctaaaattgaaatgtacagcttcgacgcagatggaccgtcaatttatgatgcttctaaggaagaaaagaagaaattcgttaaagctttccaagaatttgacaaggctttggctgcaatcaagacctatgatgagcttgatactgaagaaggcctaatgcaattaggtgtgagcgacattacaccagatgattgggaagccatgcggggagtttacgaggatattctggacgatctgcggaataattcagatgaagatcctgatcacaatgacgacatcgatgatgaatatgaacttgaatctttcggacagaaggaaatcgatgagcgctatattatgaatttgatccaggcgttcttgccagaaagttctgacaatcaagaaaaagctagtggcaatgaaatctcgccagaaactgttaaggaaatcaatggctacattgatgaactggcgaagacaaacgaacttttggcagaaattatgcgtaagctttggcaacagattttgcaaaatccagctgaatacgctggtaagcaagtcgatgaattgctggagtccctgattgaccaagaattacaatcaatcatgcgtgagtttgctgataagtacaaggttgactacgaccagttccgctacgttatggctaactatgaccctaagttaaagggaaataagcaaaaggggatgaacgaccttttggacaaggaacgttttgtcgactacttgaatgacaatccggattctgacttaaataagccgtaccgctggaagagtgaagttcgggaacaggccaagcaatactatgtcgataagattgggccgttaattaacagagaagcatag

SEQ ID NO: 82 - protein, 1006 aa, Lactobacillus delbrueckii
MTLESQLEDNLIAQLTQDVHQWKFRDDLRTVDQLWDNFFRILESNNKDQLNDHPLTPNEKMTVRTAIVKPTFYRATEFMVGANRQVRYHLRREDSSIPDADLLILDNTNIAGGNSVYEVVHQVQLQKKTALNQDRRFDVSLLINGLPVIHIELKAPNVPYKKAFNQIQKYIDEGQFTDIYSFVEMFVVTNGTQTRYISAGQNLNAKFLTAWVDKNNKRVDNYLSFAEEVLSIPAAHHMIADYVVLDSESKSVILLRPYQIHAIQAIFKASRESKSGYIWHTTGSGKTLTSYKVARNLLQIPSIDKSIFLIDRKDLDTQTTTAFKIYANNDTISVNETNNSYDLADQMTDGDRTVVVTTRQKMQNMFKRIDELDQLPKRYENLKNMRLAFIVDECHRTITPSQKREIDKFFNRKPLWYGFTGTPIFNENARAKNGQDARTTEELYGPVLHKYTIGDAIRDKMVLGFSIDNQGGSNEDGNEEDTKKMDQIYRSKAHMHSVATAVIKAAYRKQGLISGKKYSAILTTSSIEQAQKYYRIFKKIIDGEDEEFKIPERIKKVAPDFPKIAITYSVSENEDDSESVQDEMKQSLADYNAVYGTNFSMAELDQYNQNVNARLARKKAQYQADNQRLDLVIVVNRLLTGFDSPSLSTLYIDRPPMSPQDIIQAFSRTNRIFDKDKTWGQIVTYQYPKTFSEKIDDAIVLYSNGGEKYAVAPSWEESKQSYISARSKIEMYSFDADGPSIYDASKEEKKKFVKAFQEFDKALAAIKTYDELDTEEGLMQLGVSDITPDDWEAMRGVYEDILDDLRNNSDEDPDHNDDIDDEYELESFGQKEIDERYIMNLIQAFLPESSDNQEKASGNEISPETVKEINGYIDELAKTNELLAEIMRKLWQQILQNPAEYAGKQVDELLESLIDQELQSIMREFADKYKVDYDQFRYVMANYDPKLKGNKQKGMNDLLDKERFVDYLNDNPDSDLNKPYRWKSEVREQAKQYYVDKIGPLINREA

SEQ ID NO: 83 - DNA, 2979 bp, Lactobacillus L. farciminis
atggtgttgtacagagcaaaaagggagcttgcttttgagaaagagtttgtagaaaccttaactcagaacgggtggacgtataacaaagcactagataatgcgacacccaaggatttggaaaaccatttccgtgagattctcaatcaaaataatcatagtgttctgaacggagtaaaaatcactgatactgaaatgagtgaaattatgcgtaatatcggtggaaaaactccaactgaaatgaatgaatttttaactggtaattatgaatcaatcttaaatattgcaagagataatccggaattaggaactatggacttgaagttgttttggcgtgatgcaattgctggtggacaaatgcgttatgaagttattcgtcaagctattcgtccaggcaaagaagattcacctgataatgttaaccgtcgttttgatgtgacattgttattcaatggattacccttgattcaaattgaagagaaaaaagtcgatgtcagtatcaaggaagcatcaaatcaaatcgtaaaatacaaatcagaaaataagtatgacggtttattttcagccgttcagatttttgtggccttaaaagaagacacggcccgttattttgctaacgaaaagagtgcggacttgttcaataataaattcttctttgaatggttagataagaaaaatcaaccagtccataattggaaacaatttatcgaagactttttaaaaatacctatggcacacaatcttattagtaattacacagttgctgatggagatgccttaaaagttttacgtccatatcaaattcatgctgtaaatgctgttcgtgaagctttttctaagcatgaagatggttacgtttggcacgctacagggtctggaaaaacactcacagcctataaaatagctactttattgcagagaaatccaaataatcaagtgattttcttgtcagatagaaaagagctagataatcaatcaggaaagaattttagtaagttctcaactaatagtgacgatactatttttgaaactaataatactggagaattaattaaaagacttaggagttctaagccgggggtcattacaacgaccattaacaaaatgaaaatagccgttgaaagaaatgaagaagctattaatactggtcatagagaacctttagccagtgtaatgaagaaacgcatggtatttatcgttgatgaagctcacagatcgcaatttggagaaatgcaaaaagttattcgccaagcttttcctaaacagaattggtatggatttaccggaactccaatttttgatttcaataaaacgccacaagatcaaactaccgagagccagtttggaccagagcttcatcgctacaacatcgggaacgcactaagtgatggggctattttgccatttaattctgagtatgtcagtttgatgcaggtaactgatgaacgtaatggtgatgaagtagaagaagagcaaatacctgacgaagcatataacggtgataaggaggttgctcaaaattatcgtttaaaagttgtgaagtggattattaagaattggcgtagaaagtctgaaaagggtaaattcaatgctatttttgcgactgtagacattaatcaggccttgaagtattaccgactattcaaaaaaatggaacaaaaaggaaagcataaccttaaagttgctttgacttattccattaatgaaaatggcgatgccaatcaagaacaacgttcaggtttagcagaggctatgagagactactcgattcgttatgctggatcagaaacggcattttctctcgataacgtgaatgtctatatcgatgatgttgcaaaaagaacagctcgtactgaagcacaatacaaaaacttgccaccagataaagaaattgatctaacgattgtagtggcacgtttattgacaggttttgacgcaccgagattgaatacattgtatttagataaattgatgcaatatcaaggattgattcaagctttcgctagaactaatcgtgtttatgacaagaataaaacgcaaggaaacatcgtcatgttcagacgccctaaactgatgagagcaagaactgaagatgcgtttgaaaagtacgctggagaaggttcattcaagaaagtctttcgacctgaatttcatgaaatggaagatactttcaaggaagctgttaaggaactaaaagagtttactccaactcctgaagtggcgaacaatttaactaaatccactgaaaaagaacaagtggatttcttaaagaaatttaggaatttatctaaagaattacaatacatctcttcatattctgattttgattgggttgaacatgctgacgagtatggaataactaaagaagaatttggttatttccaaggtgcttttcaaaatattagggattatttaaaggaacataaacctgacgataaagatgattcggatcctatttcattaaaatatgaccttgacgatgtagtaattactgaactttttatagataaagaatatgtcttaggattagcaactaaatacttgttagatacagaaaacctatttgcagctgatgaatttaaccaagctgccgataaatttgcaaaatccggaaatcaacgtgaagctgatagtatccgagaattcgtgacagaagaaagaaaacgtggagatatacctgctaattatgatgccagagctagttatgcactccatcaaagtagaaagaagcaacaaaaaataactaaattcgtcaatgaatatggacttgatgaagaattatttaaccgcttggtaactgaatatgaagcaaccggtgaatttggacatgaacaagctttgaaacagacggctgatattaaagttgccgaaagtaacggccatgaatatcgcaatatcttgagttttaaaggttcagttcagcgtgcttggagaaagtttatcaaagacgacttagcaccatacattgcaggggagaaataa

SEQ ID NO: 84 - protein, 992 aa, Lactobacillus L. farciminis
MVLYRAKRELAFEKEFVETLTQNGWTYNKALDNATPKDLENHFREILNQNNHSVLNGVKITDTEMSEIMRNIGGKTPTEMNEFLTGNYESILNIARDNPELGTMDLKLFWRDAIAGGQMRYEVIRQAIRPGKEDSPDNVNRRFDVTLLFNGLPLIQIEEKKVDVSIKEASNQIVKYKSENKYDGLFSAVQIFVALKEDTARYFANEKSADLFNNKFFFEWLDKKNQPVHNWKQFIEDFLKIPMAHNLISNYTVADGDALKVLRPYQIHAVNAVREAFSKHEDGYVWHATGSGKTLTAYKIATLLQRNPNNQVIFLSDRKELDNQSGKNFSKFSTNSDDTIFETNNTGELIKRLRSSKPGVITTTINKMKIAVERNEEAINTGHREPLASVMKKRMVFIVDEAHRSQFGEMQKVIRQAFPKQNWYGFTGTPIFDFNKTPQDQTTESQFGPELHRYNIGNALSDGAILPFNSEYVSLMQVTDERNGDEVEEEQIPDEAYNGDKEVAQNYRLKVVKWIIKNWRRKSEKGKFNAIFATVDINQALKYYRLFKKMEQKGKHNLKVALTYSINENGDANQEQRSGLAEAMRDYSIRYAGSETAFSLDNVNVYIDDVAKRTARTEAQYKNLPPDKEIDLTIVVARLLTGFDAPRLNTLYLDKLMQYQGLIQAFARTNRVYDKNKTQGNIVMFRRPKLMRARTEDAFEKYAGEGSFKKVFRPEFHEMEDTFKEAVKELKEFTPTPEVANNLTKSTEKEQVDFLKKFRNLSKELQYISSYSDFDWVEHADEYGITKEEFGYFQGAFQNIRDYLKEHKPDDKDDSDPISLKYDLDDVVITELFIDKEYVLGLATKYLLDTENLFAADEFNQAADKFAKSGNQREADSIREFVTEERKRGDIPANYDARASYALHQSRKKQQKITKFVNEYGLDEELFNRLVTEYEATGEFGHEQALKQTADIKVAESNGHEYRNILSFKGSVQRAWRKFIKDDLAPYIAGEK

SEQ ID NO: 85 - DNA, 225 bp, Lactobacillus fermentum
atgggtgaagatacgttacaagaaattgccaaagaattggtaggaacagtgcgtaaatacgcagctactcctgattgggttcaaaggaagacgacacaagccgctatgcgacaagctgttcgtcgtatgttaaaagatcatggatacccgccaacgtttgcgccagctgcagtagataccattattgaacaggcacagacaatggcatttgaaaatcacaactag

SEQ ID NO: 86 - protein, 74 aa, Lactobacillus fermentum
MGEDTLQEIAKELVGTVRKYAATPDWVQRKTTQAAMRQAVRRMLKDHGYPPTFAPAAVDTIIEQAQTMAFENHN

SEQ ID NO: 87 - DNA, 225 bp, Lactobacillus fermentum; identical to SEQ ID NO: 85

SEQ ID NO: 88 - protein, 74 aa, Lactobacillus fermentum; identical to SEQ ID NO: 86

SEQ ID NO: 89 - DNA, 3342 bp, Lactobacillus gasseri
atgctatccgtgactaactttgattatttattagaagaaccacaatttaaagatttcgtggaaattgcaatagctgctgagaaagtagctgttattgatcctgcaacatcggttattgactgccgccgtgcaatggaattggcagttaagtggatgtattcggttgataaagatttaagaacgccataccaagataaattggtaaccttgataaacaccttagactttaaggatattgttgatcctaatacttggcaaggtttggatctgattcgccgattaggaaacgtggcagtacatactaatcgaaaagtatctctagatgaagctgttttatgtttaaaggctttatttagtttttttgacatgcttgattattgctatggtagtaattatcaaaagaaagattttgataaatctcttgttggaaaatatcgtttggaatttattccaaaagtagtgtcagccgaaaaggctacgttttctcttgataaactgacgaagaagaacaaatctttgcaggaatctatgactgcgcaaagaaaggcacaggaagatagctataatcccaagccttttggaatatcagaatttaaaaccaggaaaatctacattgatgctatgctagcagaagctggttgggttgaaggacaaaattggttaaacgaagtagaacttaaaggaatgcctaataaagcaggaataggatacgctgattatgttctatatgatgatgcacaccaacctcttgcacttattgaagccaagaaaacatgcaaagatgttgctgttggtcgtcagcaagcaaaactatatgctgatttactagagaaaaaatatggacgtagaccagttgtatttttaagtaatggttttgaaacgagaattattgataatcaatatcccgaaagacaagtttcatctatttattctaagcgtgatttagaaaaattatttaatttacaaaaagtgcgtcagccattaactaatatcatagttgatgataatattgctggtcggtattaccaaaaagctgctattcaggcagtgtgtgaaagtttttcaaaggaaaatagacgcaaagcgttattagtcatggcaacgggatcaggtaaaactagaactgcagtgggcttggttaaggttcttttgaatgctggttggattaaacatgtcttatttttggctgatagggatgcactagtaacacaggctaaaaggagctttgtaaacttgttaccagacttatcttcaactaacttagtcgaagataagtcaaattataatgcgcgatgtgtattttctacctatgctacgatgatgaatgttatcgatactgcaacagatgacgataaaaagaagttatatactgcgggacattttgatctgattattgtcgatgaagctcataggtcaatttataacaaatatcggaatatattcacttattttgatgctccattggttggtctgaccgcaacccctaaagatgatattgataaaaatacatattcgatttttaatctagaagatggtgttccgacttatggctatgatctggcacaagcagttgatgatggctacttagtgccatacaaatctatcgaaactcatttaaagtttatggaaaatggtattaattacgatgatctaagtactcaagagaaagaagaatatgaagaaactttcactgatgaagatggtgatttaccaaagaagatagactcaggaaagttgaataaatggttgtttaataaagatacaattcgtaaagttttgaatattttgatgaatcagggcctaaaaattgattatggcgaaaaaatagggaaaactattatttttgctaaaaatcatcgtcatgcggaagaaatcctaaaagttttcaatgaagagtatcctcaatttagtagaaatactcatggacaaccatatgcaaccgtaatcgataattatactaactattctcaaagtgcaattgatgaattttcagatccagataagttaccacaaatagctgtttcagttgatatgttggatactggaattgatgtacctgaatgcttaaacttggtatttttcaaaaaagtaatgagtaaagcaaaattcttccaaatgatcggacgtggaactcgattgtgtccacacttactagatggaaaagataagcaagaattttatatttttgatttttgtgataattttcattttttccgcatgggaaaaggacatgaagcaggagttcaagaaactttgcaaagtgctttatttaacttaaagatggaattagttcggaaattgcaagaagaaccttatcaaacagatgattttaatcaatatcgtaaaacattggttgaagatctatgtaaaaaggttaaagaattaaatagaaataattttgctgttaagcaacatattgcttatgttgataagttttctcaaattgaaaattataataatttgacttatgaagatattgtaaatactaagaaggaattatctccgttgattcttcctgataatgatgagcctaatgctctaagatttgatgctttagtttataaaatggaacttgcaaaaatgtcacaagaatcatatgggcggctaaaaattgatctatgtaataaggtttctaaactctctgatttaatgactattccacaagttaaggaaaaaaaggatttaattaaagaaatattacaaccagaatatgttgaatctactgatgttaaagacttagagtatatccggcaaagtattagagatcttattcagtaccttcctaaaaaaggaacggtatattatacaaattttgctgacactgtattagattcgactattcatgacgctgaacttgaaacagatactttaaagaactataaggcaaaggcggaattttatattaaacaacatcaaagtgaaaatcttatggtgaagattagagacaatgaacctttaagcagccaggatttaaaagaattagaatctattttatggcaaaagctgggaagtaaggaagaatatcaaaaagaaattggtaataaggcaccaggcgaatttgtacgtagcatagttggattagatatgcatgcggctaaaaaggcttttaataaatacctagatactgttcctttaaataagcaacaaatctattttataaatgaaattatcgagtacattgttaagaatggaacactgactgatatgcatgttctacaggaatctccatttacaaatcaaggttcgatttctgaactttttgaatcagatataactatttggttgaaagtaaaaacagcaattgatgaaattaatagtaatgctggagtagttgtagcttaa

SEQ ID NO: 90 - protein, 1113 aa, Lactobacillus gasseri
MLSVTNFDYLLEEPQFKDFVEIAIAAEKVAVIDPATSVIDCRRAMELAVKWMYSVDKDLRTPYQDKLVTLINTLDFKDIVDPNTWQGLDLIRRLGNVAVHTNRKVSLDEAVLCLKALFSFFDMLDYCYGSNYQKKDFDKSLVGKYRLEFIPKVVSAEKATFSLDKLTKKNKSLQESMTAQRKAQEDSYNPKPFGISEFKTRKIYIDAMLAEAGWVEGQNWLNEVELKGMPNKAGIGYADYVLYDDAHQPLALIEAKKTCKDVAVGRQQAKLYADLLEKKYGRRPVVFLSNGFETRIIDNQYPERQVSSIYSKRDLEKLFNLQKVRQPLTNIIVDDNIAGRYYQKAAIQAVCESFSKENRRKALLVMATGSGKTRTAVGLVKVLLNAGWIKHVLFLADRDALVTQAKRSFVNLLPDLSSTNLVEDKSNYNARCVFSTYATMMNVIDTATDDDKKKLYTAGHFDLIIVDEAHRSIYNKYRNIFTYFDAPLVGLTATPKDDIDKNTYSIFNLEDGVPTYGYDLAQAVDDGYLVPYKSIETHLKFMENGINYDDLSTQEKEEYEETFTDEDGDLPKKIDSGKLNKWLFNKDTIRKVLNILMNQGLKIDYGEKIGKTIIFAKNHRHAEEILKVFNEEYPQFSRNTHGQPYATVIDNYTNYSQSAIDEFSDPDKLPQIAVSVDMLDTGIDVPECLNLVFFKKVMSKAKFFQMIGRGTRLCPHLLDGKDKQEFYIFDFCDNFHFFRMGKGHEAGVQETLQSALFNLKMELVRKLQEEPYQTDDFNQYRKTLVEDLCKKVKELNRNNFAVKQHIAYVDKFSQIENYNNLTYEDIVNTKKELSPLILPDNDEPNALRFDALVYKMELAKMSQESYGRLKIDLCNKVSKLSDLMTIPQVKEKKDLIKEILQPEYVESTDVKDLEYIRQSIRDLIQYLPKKGTVYYTNFADTVLDSTIHDAELETDTLKNYKAKAEFYIKQHQSENLMVKIRDNEPLSSQDLKELESILWQKLGSKEEYQKEIGNKAPGEFVRSIVGLDMHAAKKAFNKYLDTVPLNKQQIYFINEIIEYIVKNGTLTDMHVLQESPFTNQGSISELFESDITIWLKVKTAIDEINSNAGVVVA

SEQ ID NO: 91 - DNA, 3213 bp, Lactobacillus helveticus
atgtctaattttaatacttcagataaaaattatcatgaatatgctaaattggcttctagtgctgagagtttgattttttcagatccaagaagcagtttaactgtttttggtacttttggtgaacaattaacaagagaaattatgcatttagatggtttaggcgattgggagttgaaccaaaaagcacgaatcgataagatgcgttactccggaaatggctatcctgatacagttttattagcattagatgagatcagacgtaagcggaatggagctactcatgataatcaatttatcgcaaccaaaggtgaagctttaaaaattgatcaaaaggcttatttagtttggaaatggttcttagaaagtttttctttaaatgatgttcctgaatatgttacaccagttgatcaaagaaatatattaaagagtcaagaagataagattaaagctttagaagaaaaaattaagcagctgcaagaaaaccgaccacaaattactatttcagcggaagaaagaacaagaagacgcaaggtaaatgttcaatttgctaaaaagcatccgttaaatgaggaagaaactagacaattaattgatagccaattacgtaatgcaggttgggaagcagatacaccaagactaaataattggaagcatcaaactgaaccacagaaaggtcatagtatggcgattgcagaatgggtattgcctaatggtcaaagagctgactatgcactttttaaggggttagatttttatggcattgttgaagcaaagagatgggatcaagatattgcaggacaaatggcccagcctaaagaatatgctaaggaagtcccatttagatcagattaccatttaatagggcaagagatgggtgattacaaggttccttttatttatgctgcaaatggtcgtccatatttagaacaatataaggaaaaatcaggtatttggttctgggatgcacgtaatccaaaagaaaatgcatatgctttggaagaatttcatactccggaggatttggcattaaagttaactgctaagaataaggatgaagcaaataaagatttggcagatgatgaagattatccgcaatttgcagctcgtccatatcaacttgatgcgattcagtctttagaaaatgcaattaaagatggaaaaaaacgtatcttgcttgcgatggctacaggtactggtaaaactagaaccgctatttcgttaatgtatcgtttgctaaagcataaaagagctagaagaatcctttatttagttgatcgaaactcactcggtcgccaaactgctaatgcaattaaagataataagataggtacaatgtcgatttcttctatttatggattaaaagaattatctgataaagtgcctgatgcttctactaagattcaaattgcgactgttcagggaatgattaaaagattattctttaatgatgataattctgaaaagccttcagttggtcaatatgatttcattattgttgatgaagctcaccgcggttatgcagaagatagagggctaagcgatcaagaatatgaaaattatgatcaagaagaatatgttagtcagtaccgtcgagtagttgattattttgacgctactgcaatcggaatgactgctacaccagcattacagacaactgaaatctttggtaatccagtatattcttatagctatcaacaagctgtccttgatggctacttggttgaccatgatgcaccagttattattcaaactaaattagctaaagaaggaattcattttaaaaaaggtgcagaagttgatgtctttaatcaggatgaaaagaccatcgataaagaaaaattgccagataatatgaatttcgatatcaaagactttaatcatagagtaattacgcctagttttaacaaggtggtttgtgatgaactagttagaaattatcttgatcctacggatagggatgcaggtaaaactcttatttttgcggcaacagatgaacatgctgacatggtggttgatttgttgaagaaggcctttaaagatgatggtcgtccagtggatgatgatgcgattgaaaaaatcacgggttctattcgtcatcctaaccaagaaattagaaactttaaaaatgaagattatcctaatattgttgtcacagttgatcttttgactactggggttgatgtacctgcaattactaatattgtcttcttaagaagggtacagtctagaattctgtatgaacagatgctaggacgtgcaactagattgtgtccagagatccataaggataaatttagaatttttgatgcagttggtatttatgatgcaatgaacaaggtaactaatatgaagccagtcgttcaaaatcctggccataatgtaaattatttcttgcatcataaggaagactattttgaaattgcagaagatagtcatcagtatcaagttgatatggctggcgctgttgaacgaaaaatcaaacgtcttgatgatcaaggacgaaataagtttgaacgtttagctgaaataccatcggttgatgaatgggctggtaagttaagcaagatgagtaaagccgactttatgaagcaatggccgaagtttgaacaacttgatcaggtgcatccagcgaaaaagcagtttatctctaatgagcaggatgaagttattggaactacacgaggttatggtcaaggcaacaacaagccggaagattatattgatagttttaacaagttcattaaagaaaatgtaaatgttattcctgctttgcaaatcgtggctactaaaccgaaggatttaacttttgatgagttgaaagatatcaagttaaagttggagcagaatggatttaaggaaaatgatctgcaatctgcttggaaaacaactaaacatgagcagacaacagcagatattatcagctttattaggcaagccgcatcaggatcgaaactggttgaccatgatgtgagaattcataatgcgatgcagaaggtttatggcatggcggactggaacatcatgcagaagaaatggttgaagagaattgaaaatcaattgctttcttctactgtattaggtccagatgctgagcatgcttttgatgataacttttacttcaagcgtcagggtggatataagcaaattaagaagatttttcctaaatatgctgatcagattatttatgtattgaatgaaaatttatatgtttaa

SEQ ID NO: 92 - protein, 1070 aa, Lactobacillus helveticus
MSNFNTSDKNYHEYAKLASSAESLIFSDPRSSLTVFGTFGEQLTREIMHLDGLGDWELNQKARIDKMRYSGNGYPDTVLLALDEIRRKRNGATHDNQFIATKGEALKIDQKAYLVWKWFLESFSLNDVPEYVTPVDQRNILKSQEDKIKALEEKIKQLQENRPQITISAEERTRRRKVNVQFAKKHPLNEEETRQLIDSQLRNAGWEADTPRLNNWKHQTEPQKGHSMAIAEWVLPNGQRADYALFKGLDFYGIVEAKRWDQDIAGQMAQPKEYAKEVPFRSDYHLIGQEMGDYKVPFIYAANGRPYLEQYKEKSGIWFWDARNPKENAYALEEFHTPEDLALKLTAKNKDEANKDLADDEDYPQFAARPYQLDAIQSLENAIKDGKKRILLAMATGTGKTRTAISLMYRLLKHKRARRILYLVDRNSLGRQTANAIKDNKIGTMSISSIYGLKELSDKVPDASTKIQIATVQGMIKRLFFNDDNSEKPSVGQYDFIIVDEAHRGYAEDRGLSDQEYENYDQEEYVSQYRRVVDYFDATAIGMTATPALQTTEIFGNPVYSYSYQQAVLDGYLVDHDAPVIIQTKLAKEGIHFKKGAEVDVFNQDEKTIDKEKLPDNMNFDIKDFNHRVITPSFNKVVCDELVRNYLDPTDRDAGKTLIFAATDEHADMVVDLLKKAFKDDGRPVDDDAIEKITGSIRHPNQEIRNFKNEDYPNIVVTVDLLTTGVDVPAITNIVFLRRVQSRILYEQMLGRATRLCPEIHKDKFRIFDAVGIYDAMNKVTNMKPVVQNPGHNVNYFLHHKEDYFEIAEDSHQYQVDMAGAVERKIKRLDDQGRNKFERLAEIPSVDEWAGKLSKMSKADFMKQWPKFEQLDQVHPAKKQFISNEQDEVIGTTRGYGQGNNKPEDYIDSFNKFIKENVNVIPALQIVATKPKDLTFDELKDIKLKLEQNGFKENDLQSAWKTTKHEQTTADIISFIRQAASGSKLVDHDVRIHNAMQKVYGMADWNIMQKKWLKRIENQLLSSTVLGPDAEHAFDDNFYFKRQGGYKQIKKIFPKYADQIIYVLNENLYV

SEQ ID NO: 93 - DNA, 3024 bp, Lactobacillus helveticus
gtggaacaagagaatgtactcgaacaaaatttaattgaccaacttacccatggagaatcacaatggactcttcgtgatgatattaaaaatgaagatgatctttggaataacttttttgaaattttatctcgctcaaacaaagatgttttaaaggatgttccattaactgacaatgaaaaagcgattattaaatctaaaataattcatccaactttctataaatctgcagaatggcttgcaggtgttaatggggaagttagattacaaattcaaagggataatactcaattaggtactgctgactttatagtcattaacaataataatattgctggtggcaattctgtctatgaagtagtgcatcaaattcaatttcataaacgcagagaaatagatcgcaatcgtcgtggggatgtaacgcttttaatcaacggcttaccaatgattcatatcgaattgaaaaataggacacactctcctaaagaagctttcaatcagattcaaaagtatattgatgagcagatgtttaatgggattttctcaactcttcaattctttgtcgtaactaacggaagttatacccaatacattgctgctggacaacaattaaaagagaagtttttaactacttgggtagataaagaaaataagccagtgcaaaattaccttgaatttgctaaagacgtactgtctattcctgcagctcataatatggttgctaactatatagctttggatagcactcaacgcagcattatagtgttacgcccatatcaaattcatgcaattcaagccatttttgatgcatcatacggaaaagataataaagatcaaccatattctggttttgtttggcatacaacaggttccggtaagactttaacttcttataaggttgcacataatttacttaaaatcccatcaattcaaaagacgatatttctaattgatcgtaatgatttagatactcaaactactcaagcatttgaaacctatgctcagaatgactcaattgacgttgaaggtactgaaaatagttattctcttgcccgtaagttagtaagttcagataagagggttatcgttactactagacaaaaaatgcaggctttgttcaagcgaatcgctcaagatcaagaacaaaaacgtctataccgtaagttaaaagatgtaaaattagcctttatcgttgatgaatgtcaccgtgcagtttctcccgatcaaaagaatgaaatagatgcattttttactaaaaatccacctttatggtatggcttcactggtactcctatttttgctgaaaatgctcgtgaagctaagggaaacaatgctcgaacaactgaacaacaatatggaaaatgcttgcataaatatacaattaaggacgcaattagagataaagctgtacttggatttcaagtagaagaggaaagtaatgtgtcagaagatgctgatgaatcagatactgatgctagaaataaagaatatgcatccctctcacacatgaaggcagtagtaaaaagaattctaaataattcatatcgcaaattaggtatttataacaaagataatcgtggttacacctacgatgccatttttactacgagttctattaagcaagctcaaaaatattatcgaatctttagggatgtaattaatgataaagatccagatattaaaattcctaatcgaattaagaaagtattgccagattttcctaaaatagcaattacatactcgattggcgaaaatggtgatggcgatgaggctaaccaaaatgagatgaagcaatctctagaagattacaacaagatgttcaatactcattattctatggctgaattaggtgcatataacacaaatgtaaatgatcgtttagctcgtaaaaaagatgagtttaaaccacgttctcaacaattagatattgtcatagtagttgatcgtctgttaactggttttgacgcaccatgtttatcaactttattcttagatcgtgcaccaatgccgtataaggatttaatccaagcattttcaagaactaaccgtatcttcgatagagataaaagatacggacagatagttacttatcaataccctaagaaatataaagaaagcatcaatggtgccttaatgctttataccgaaggtagcgaaaagcaagctcttgctccaacttgggatgaatcaattctacagttcaataatgctgcaaagaagatcattaagtatcagggagatcaaggtattccaattactgaagctccgcttgatgatcaaaaacgattcttaaaagaatatcaggattttgataaaagtttaggtgcgatcaaaacttacaatgaattcaataatattgatcttgaaaaagattatgacttagatccgatgtttattgaagatactcgtgcaacatatgaagttgttaaagaaaaagttagagaagctacaggtaaggacaagccggcaactgaagatgatgatcagttcgatccagattatgagcttgaaaacaccggtagacaagagattaattatgcttatattgtgcaattgattcaggcttatattccatcagatgataaagaaaataataagagaactaaggctgaagtaaaagaaatcgatgactatattgaaaatctaggtaagaataataagtcattggctgatattgtaaataatctatggtttcaaattaaatttgatcctgaaaagtttagaaataagcaagttaatgaactcttacaaaacatgattgatgatgctagagaagatctaattaaaaagttcgctgatgaaaatggacttaatattgataatcttaaatttgttattcgtcactatgatccaaatgaagttgatcatcaacaaacaggaattaatgctttactatcatttaaagtatttagtgaatttcgtaaaactcatcctgatatgaatatgttgcaatggaagaaaaaagttcgtttaggactgaataagttctatcaggatcagatttcaccgttggagaataaagactaa

SEQ ID NO: 94 - protein, 1007 aa, Lactobacillus helveticus
MEQENVLEQNLIDQLTHGESQWTLRDDIKNEDDLWNNFFEILSRSNKDVLKDVPLTDNEKAIIKSKIIHPTFYKSAEWLAGVNGEVRLQIQRDNTQLGTADFIVINNNNIAGGNSVYEVVHQIQFHKRREIDRNRRGDVTLLINGLPMIHIELKNRTHSPKEAFNQIQKYIDEQMFNGIFSTLQFFVVTNGSYTQYIAAGQQLKEKFLTTWVDKENKPVQNYLEFAKDVLSIPAAHNMVANYIALDSTQRSIIVLRPYQIHAIQAIFDASYGKDNKDQPYSGFVWHTTGSGKTLTSYKVAHNLLKIPSIQKTIFLIDRNDLDTQTTQAFETYAQNDSIDVEGTENSYSLARKLVSSDKRVIVTTRQKMQALFKRIAQDQEQKRLYRKLKDVKLAFIVDECHRAVSPDQKNEIDAFFTKNPPLWYGFTGTPIFAENAREAKGNNARTTEQQYGKCLHKYTIKDAIRDKAVLGFQVEEESNVSEDADESDTDARNKEYASLSHMKAVVKRILNNSYRKLGIYNKDNRGYTYDAIFTTSSIKQAQKYYRIFRDVINDKDPDIKIPNRIKKVLPDFPKIAITYSIGENGDGDEANQNEMKQSLEDYNKMFNTHYSMAELGAYNTNVNDRLARKKDEFKPRSQQLDIVIVVDRLLTGFDAPCLSTLFLDRAPMPYKDLIQAFSRTNRIFDRDKRYGQIVTYQYPKKYKESINGALMLYTEGSEKQALAPTWDESILQFNNAAKKIIKYQGDQGIPITEAPLDDQKRFLKEYQDFDKSLGAIKTYNEFNNIDLEKDYDLDPMFIEDTRATYEVVKEKVREATGKDKPATEDDDQFDPDYELENTGRQEINYAYIVQLIQAYIPSDDKENNKRTKAEVKEIDDYIENLGKNNKSLADIVNNLWFQIKFDPEKFRNKQVNELLQNMIDDAREDLIKKFADENGLNIDNLKFVIRHYDPNEVDHQQTGINALLSFKVFSEFRKTHPDMNMLQWKKKVRLGLNKFYQDQISPLENKD

SEQ ID NO: 95 - DNA, 3213 bp, Lactobacillus helveticus
atgtctaattttaatacttcagataaaaattatcatgaatatgctaaattggcttctagtgctgagagtttgattttttcagatccaagaagcagtttaactgtttttggtacttttggtgaacaattaacaagagaaattatgcatttagatggtttaggcgattgggagttgaaccaaaaagcacgaatcgataagatgcgttactccggaaatggctatcctgatgcagttttattagcattagatgagatcagacgtaagcggaatggagctactcatgataatcaatttatcgcaaccaaaggtgcagctttaaaaattgatcaaaaggcttatttagtttggaaatggttcttagaaagtttttctttaaatgatgttcctgaatatgttacaccagttgatcaaagaaatatattaaagagtcaagcagataagattaaagctttagaagaaaaaattaagcagctgcaagaaaaccgaccacaaattactatttcagcggaagaaagaacaagaagacgcaaggtaaatgttcaatttgctaaaaagcatccgttaaatgaggaagaaactagacaattaattgatagccaattacgtaatgcaggttgggaagcagatacaccaagactaaataattggaagcatcaaactgaaccacagaaaggtcatagtatggcgattgcagaatgggtattgcctaatggtcaaagagctgactatgcactttttaaggggttagatttttatggcattgttgaagcaaagagatgggatcaagatattgcaggacaaatggcccagcctaaagaatatgctaaggaagtcccatttagatcagattaccatttaatagggcaagagatgggtgattacaaggttccttttatttatgctgcaaatggtcgtccatatttagaacaatataaggaaaaatcaggtatttggttctgggatgcacgtaatccaaaagaaaatgcatatgctttggaagaatttcatactccggaggatttggcattaaagttaactgctaagaataaggatgaagcaaataaagatttggcagatgatgaagattatccgcaatttgcagctcgtccatatcaacttgatgcgattcagtctttagaaaatgcaattaaagatggaaaaaaacgtatcttgcttgcgatggctacaggtactggtaaaactagaaccgctatttcgttaatgtatcgtttgctaaagcataaaagagctagaagaatcctttatttagttgatcgaaattcacttggtcgccagactgctaatgcaattaaagataataagataggtacaatgtcgatttcttctatttatggattaaaagaattatctgataaagtgcctgatgcttctactaagattcaaattgcgactgttcagggaatgattaaaagattattctttaatgatgataattctgaaaagccttcagttggtcaatatgatttcattattgttgatgaagctcaccgcggttatgcagaagatagagggctaagcgatcaagaatatgaaaattatgatcaagaagaatatgttagtcagtaccgtcgagtagttgattattttgacgctactgcaatcggaatgactgctacaccagcattacagacaactgaaatctttggtaatccagtatattcttatagctatcaacaggctgtccttgatggctacttggttgaccacgatgcaccagttattattcaaactaaattagctaaagaaggaattcattttaaaaaaggtgcagaagttgatgtctttaatcaggatgaaaagaccatcgataaagaaaaattgccagataatatgaatttcgatatcaaagactttaatcatagagtaattacgcctagttttaacaaggtagtttgtgatgaactagttagaaattatctagatcctacggatagggatggaggtaaaactcttatttttgcggcaacagatgaacatgctgatatggtggttgatttgttgaagaaggcctttaaagatgatggtcgtccagtggatgatgatgcaattgaaaaaatcacgggttctattcgtcatcctaaccaagaaattagaaactttaaaaatgaagattatcctaatattgttgtcacagttgatcttttgactactggtgttgatgtacctgcaattactaatattgtcttcttaagaagggtacagtctagaattctgtatgaacagatgctaggacgtgcaactagattgtgtccagagatccataaggataaatttagaatttttgatgcagttggtatttatgatgcaatgaacaaggtaactaatatgaagccagtcgttcaaaatcctggccataatgtaaattatttcttgcatcataaggaagactattttgaaattgcagaagatagtcatcagtatcaagttgatatggctggcgctgttgaacgaaaaatcaaacgtcttgatgatcaaggacgaaataagtttgaacgtttagctgaaataccatcggttgatgaatgggccggtaaattaagcaagatgagtaaagccgactttatgaagcaatggccgaagtttgaacaacttgatcaggtgcatccagcgaaaaagcagtttatctctaatgagcaggatgaagttattggaactacacgaggttatggtcaaggtaacaacaagccggaagattatattgatagctttaataagtttgtcaaagaaaatgtaaatgttattcctgctttgcaaatcgtggctactagaccgaaggatttaacttttgatgagttgaaagatatcaagttaaagttagagcagaatggatttaaggaaaatgatctgcaatctgcttggaaaacaactaaacatgagcagacaacagcagatattattagctttattagacaagctgcatcaggatcgaaactggttgaccatgatgtgagaattcataatgcgatgcagaaggtttatggcatggcggactggaacattatgcagaagaaatggttgaagagaattgaaaatcaattgctttcttctactgtattaggtccagacgctgagcatgcttttgatgataacttttacttcaagcgtcagggtggatataagcaaattaagaagatttttcctaaatatgctgatcagattatttatgtattgaatgaaaatttatatgtttaa

SEQ ID NO: 96 - protein, 1070 aa, Lactobacillus helveticus
MSNFNTSDKNYHEYAKLASSAESLIFSDPRSSLTVFGTFGEQLTREIMHLDGLGDWELNQKARIDKMRYSGNGYPDAVLLALDEIRRKRNGATHDNQFIATKGAALKIDQKAYLVWKWFLESFSLNDVPEYVTPVDQRNILKSQADKIKALEEKIKQLQENRPQITISAEERTRRRKVNVQFAKKHPLNEEETRQLIDSQLRNAGWEADTPRLNNWKHQTEPQKGHSMAIAEWVLPNGQRADYALFKGLDFYGIVEAKRWDQDIAGQMAQPKEYAKEVPFRSDYHLIGQEMGDYKVPFIYAANGRPYLEQYKEKSGIWFWDARNPKENAYALEEFHTPEDLALKLTAKNKDEANKDLADDEDYPQFAARPYQLDAIQSLENAIKDGKKRILLAMATGTGKTRTAISLMYRLLKHKRARRILYLVDRNSLGRQTANAIKDNKIGTMSISSIYGLKELSDKVPDASTKIQIATVQGMIKRLFFNDDNSEKPSVGQYDFIIVDEAHRGYAEDRGLSDQEYENYDQEEYVSQYRRVVDYFDATAIGMTATPALQTTEIFGNPVYSYSYQQAVLDGYLVDHDAPVIIQTKLAKEGIHFKKGAEVDVFNQDEKTIDKEKLPDNMNFDIKDFNHRVITPSFNKVVCDELVRNYLDPTDRDGGKTLIFAATDEHADMVVDLLKKAFKDDGRPVDDDAIEKITGSIRHPNQEIRNFKNEDYPNIVVTVDLLTTGVDVPAITNIVFLRRVQSRILYEQMLGRATRLCPEIHKDKFRIFDAVGIYDAMNKVTNMKPVVQNPGHNVNYFLHHKEDYFEIAEDSHQYQVDMAGAVERKIKRLDDQGRNKFERLAEIPSVDEWAGKLSKMSKADFMKQWPKFEQLDQVHPAKKQFISNEQDEVIGTTRGYGQGNNKPEDYIDSFNKFVKENVNVIPALQIVATRPKDLTFDELKDIKLKLEQNGFKENDLQSAWKTTKHEQTTADIISFIRQAASGSKLVDHDVRIHNAMQKVYGMADWNIMQKKWLKRIENQLLSSTVLGPDAEHAFDDNFYFKRQGGYKQIKKIFPKYADQIIYVLNENLYV

SEQ ID NO: 97 - DNA, 3255 bp, Lactobacillus helveticus
atgaacatatatgtatgcatttttaacgtaaggatgattggaatgtctaattttaatacttcagataaaaattatcatgaatatgctaaattggcttctagtgctgagagtttgattttttcagatccaagaagcagtttaactgtttttggtactttgggtgaacaattaacaagagaaattatgcatttagatggtttaggcgattgggagttgaaccaaaaagcacgaatcgataagatgcgttactccggaaatggctatcctgatgcagttttattagcattagatgagatcagacgtaagcggaatggagctactcatgataatcaatttatcgcaaccaaaggtgaagctttaaaaattgatcaaaaggcttatttagtttggaaatggttcttagaaagtttttctttaaatgatgttcctgaatatgttacaccagttgatcaaagaaatatattaaagagtcaagcagataagattaaagctttagaagaaaaaattaagcagctgcaagaaaaccggccacaaattactatttcagcggaagaaagaacaagaagacgcaaggtaaatgttcaatttgctaaaaagcatccgttaaatgaggaagaaactagacaattaattgatagccaattacgtaatgcaggttgggaagcagatacaccaagactaaataattggaagcatcaaactgaaccacagaaaggtcatagtatggcgattgcagaatgggtattttctaatggtcaaagagctgactatgcactttttaaggggttagatttttatggcattgttgaagcaaagagatgggatcaagatattgcaggacaaatggcccagcctaaagaatatgctaaggaagttccatttagatcagattaccatttaatagggcaagagatgggtgattacaaggttccttttatttatgctgcaaatggtcgtccatatttagaacaatataaggaaaaatcaggtatttggttctgggatgcacgtaatccaaaagaaaatgcatatgctttggaagaatttcatactccggaggatttggcattaaagttaactgctaagaataaggatgaagcaaataaagatttggcagatgatgaagattatccgcaatttgcagctcgtccatatcaacttgatgcgattcagtctttagaaaatgcaattaaagatggaaaaaaacgtatcttgcttgcgatggctacaggtactggtaaaactagaaccgctatttcgttaatgtatcgtttgctaaagcataaaagagctagaagaatcctttatttagttgatcgaaattcactcggtcgccaaactgctaatgcaattaaagataataagataggtacaatgtcgatttcttctatttatggattaaaagaattatctgataaagtgcctgatgcttctactaagattcaaattgcgactgttcagggaatgattaaaagattattctttaatgatgataattctgaaaagccttcagttggtcaatatgatttcattattgttgatgaagctcaccgcggttatgcagaagatagagggctaagcgatcaagaatatgaaaattatgatcaagaagaatatgttagtcagtaccgtcgagtagttgattattttgacgctactgcaatcggaatgactgctacaccagcattacagacaactgaaatctttggtaatccagtatattcttatagttatcaacaggctgtccttgatggctacttggttgaccacgatgcaccagttattattcaaactaaattagctaaagaagggattcattttaaaaagggtgcagaagttgatgtctttaatcaggatgaaaagaccatcgataaagaaaaattgccagataatatgaatttcgatgtcaaagactttaatcatagagtaattacgcctagttttaacaaggtggtttgtgatgaactagttagaaattatcttgatcctacggatagggatgcaggtaaaactcttatttttgcggtaacagatgaacatgctgatatggtggttgatttgttgaagaaggcctttaaagatgatggccgtccagtggatgatgatgcgattgaaaaaattacgggttctattcgtcatcctaaccaagaaattagaaactttaaaaatgaagattatcctaatattgttattacagttgatctcttgactactggggttgatgtacctgcaattactaatattgtctttttaagaagagtgcagtctagaattttgtatgagcagatgttaggacgtgcgactaggttgtgcccagaaattcataaagacaagtttagaatctttgatgcagttggcatttatgatgcaatgaataaggtaaccaatatgaagccggttgttcaaaatccgggtcataatgtaaattacttcttgcatcataaggaagactattttgaaattgcagaagatagtcatcaatatcaagttgatatggctggtgctgttgaacgaaaagttaaacgtcttgatgataaaggacgaaataagtttaaacgtttagctgaaatatcatcgattgatgaatgggccggtaaattaagcaagatgagtaaagccgactttatgaagcaatggccgaagtttgaacaacttgatcaggtgcatccagcgaaaaagcagtttatctctaatgagcaggatgaagttattggaactacacgaggttatggtcaaggtaacaacaagccggaagattatattgatagttttaataagttcattaaagaaaatgtaaatgttattcctgctttgcaaatcgtggctactaaaccgaaggatttaactttttatgagttgaaagatatcaagttaaagttggagcagaatggatttaaggaaaatgatctgcaatctgcttggaaaacaactaaacatgagcagacaacagcagatattatcagctttattaggcaagccgcatcaggatcgaaactggttgaccatgatgtgagaattcataatgcgatgcagaaggtttatggcatggcggactggaacattatgcagaagcaatggttgaagagaattgaaaatcaattgctttcttctactgtattaggtccagacgctgagcatgcttttgatgataacttttacttcaagcgtcagggtggatataagcaaattaagaagatttttcctaaatatgctgatcagattatttatgtattgaatgaaaatttatatgtttaa

SEQ ID NO: 98 - protein, 1084 aa, Lactobacillus helveticus
MNIYVCIFNVRMIGMSNFNTSDKNYHEYAKLASSAESLIFSDPRSSLTVFGTLGEQLTREIMHLDGLGDWELNQKARIDKMRYSGNGYPDAVLLALDEIRRKRNGATHDNQFIATKGEALKIDQKAYLVWKWFLESFSLNDVPEYVTPVDQRNILKSQADKIKALEEKIKQLQENRPQITISAEERTRRRKVNVQFAKKHPLNEEETRQLIDSQLRNAGWEADTPRLNNWKHQTEPQKGHSMAIAEWVFSNGQRADYALFKGLDFYGIVEAKRWDQDIAGQMAQPKEYAKEVPFRSDYHLIGQEMGDYKVPFIYAANGRPYLEQYKEKSGIWFWDARNPKENAYALEEFHTPEDLALKLTAKNKDEANKDLADDEDYPQFAARPYQLDAIQSLENAIKDGKKRILLAMATGTGKTRTAISLMYRLLKHKRARRILYLVDRNSLGRQTANAIKDNKIGTMSISSIYGLKELSDKVPDASTKIQIATVQGMIKRLFFNDDNSEKPSVGQYDFIIVDEAHRGYAEDRGLSDQEYENYDQEEYVSQYRRVVDYFDATAIGMTATPALQTTEIFGNPVYSYSYQQAVLDGYLVDHDAPVIIQTKLAKEGIHFKKGAEVDVFNQDEKTIDKEKLPDNMNFDVKDFNHRVITPSFNKVVCDELVRNYLDPTDRDAGKTLIFAVTDEHADMVVDLLKKAFKDDGRPVDDDAIEKITGSIRHPNQEIRNFKNEDYPNIVITVDLLTTGVDVPAITNIVFLRRVQSRILYEQMLGRATRLCPEIHKDKFRIFDAVGIYDAMNKVTNMKPVVQNPGHNVNYFLHHKEDYFEIAEDSHQYQVDMAGAVERKVKRLDDKGRNKFKRLAEISSIDEWAGKLSKMSKADFMKQWPKFEQLDQVHPAKKQFISNEQDEVIGTTRGYGQGNNKPEDYIDSFNKFIKENVNVIPALQIVATKPKDLTFYELKDIKLKLEQNGFKENDLQSAWKTTKHEQTTADIISFIRQAASGSKLVDHDVRIHNAMQKVYGMADWNIMQKQWLKRIENQLLSSTVLGPDAEHAFDDNFYFKRQGGYKQIKKIFPKYADQIIYVLNENLYV

SEQ ID NO: 99 - DNA, 3342 bp, Lactobacillus johnsonii
atgttatccgtgactaactttgattatttactagaagaaccacaatttaaagattttgtgcaaatagcaatagcagcagaaaaagtggctgttattgatcctgcaacatcagttattgactgtagacgtgcaatggaattggcagttaagtggatgtattcagttgattcggacctaaagaccccctatcaggataaactagtaaccttaatcaataccttagattttaaagatattgttgatcctaatacttggcaaggtctagaattaattcgccgtttaggaaatgttgccgtacataccaatagaaaagtatcactagatgaagctattttgtgtttgaaggctttgtttagtttttttgacatgcttgattattgttatggaagcaattatcagaagaaagattttgataagtcgattgttggaaattatcgtcttgagtttattccgaaagtatcgccgatagaagagtcaacaatttctcttgaaaaacttacaaagaagaatgaatctttacaagaatctttaactgcacaaagaaaagcacaagaggagagctatactccaaaaccatttggaatctctgagtttaaaactcgaaaaatctatattgatactatgctagcagaagcaggttggattgagggacaaaactggttaaatgaggttgagcttaaaggaatgcctaacaaaactggcaaaggatatgctgattacgtcttgtatgatgatgcgcatttacccttagcagttattgaagccaagaaaacttgtaaagatgtagcagttgggcgccagcaagctaaattatatgctgatatattagagaataagtatggtcgtagaccagttgtgtttttaagtaatgggtttgaaacacgaattattgataatcaatatccagaaaggcaagtttcatcaatttattctaagcgtgatttagaaaaattgtttaatttgcaaaaagtacgtcagcctttaacgaatattgtagtagatgataatattgcgggacgttattatcaaaaggctgctattcaggctgtttgcgaaagtttttcaaaagaaaatagacgtaaagctttgttagtcatggcgacggggtcgggtaaaacaagaactgcagttggattagtaaaagttcttttaaacgctggttggattaaacatgttttatttttagctgatagggatgctttggtaacacaggctaaaagaagctttgtcaatttactacccgatctttctgtaactaatttagttgaagataagaaaaactataatgctcgatgtgttttttctacctatgcaacaatgatgaatgtcatcgatacagcaatagatgatgaaaagcaaaaactgtatacagcaggccattttgacttaattattgtcgatgaggcacaccgatcaatctataataaatatagaaatatctttacttactttgacgctccattagttggtctaactgctacacctaaagatgatattgataaaaatacttattctatttttaacttggaagatggagtgcctacttatggctatgatctagcccaagctgttgacgatggatatttagtaccctataaatcaatagagactcacttaaaatttatggagaagggcattaattatgatgatttaagtgatcaagaaaaggaagaatacgaggaaactttcacggatgaagatggtgagttaccgaagaagattgaatcaggaaagttgaataagtggctgtttaataaagatacgattcgcaaagttctaaatattttaatgagtcaaggattaaagattaattatggcgaaagaataggtaaaactattattttcgctaagaatcatcgccatgctgaagaaattctaaaagtctttaatgaagaatatcctcaattttgtaaaaatggccatgggcaaccttatgcaaccgtaattgacaattatactaattactcgcaaagtgcaattgatgaattctccgatccaaataaattaccgcaaattgctatttccgttgatatgttggatacaggaattgatgtcccagaatgtttgaacttagtattttttaaaaaggtaatgagtaaggccaagttcttccagatgattggtagaggaacccgtttatgtccaaatttgttagatggaaaagataaaaaagagttttacatctttgattttggtgataacttccaatttttccgtatggaaaaaggacatgaagctggtgtccaagaaacgttgcaaagtgctttgttcaacttaaaaatggaattagtacgaaaattacaagaagcaccatatcaaacggaagactttaagcagtatcgaaaatctttgattgaagacctatctaagaaagttaaagaattaaatagaaaaaattttgctgttaaacaacatcttgcttatgttgataaattctctcaaatcgacaactataataatttaacttatgaggacatcgtaaatgttcaaaaagagctagcacctttaattcttccagataatgatgaaccaaatgccctacgctttgatgctttagtctataaaatggaactggcaaaaatgtcacaagaatcctatggacgattaaaagtagatctttgtaataagatttctaaattatctgatttaatgaccatcccacaagttaaagcaaaagccgaattgattaaaggtatattagagccagaatatgtcgaatctacgaatgttcaagatttagaacatattcgtcaaaatatacgtgatttaattcagtatcttccaaaaaagggagtagtgtactatacaaatttcactgatactatattagattcaactattcatgatgctgagcttgaaactgatactttaaaaaattataaagcaaaggcagaattttatataaagcagcatcaaagtgaaaatttaatgtgtaagattagggataatgagcctttaagtagtgaagatttgagagaattagaagatattctatggcaaaaattaggaagcaaagaagaatatcaaaaagaaattggggataaaactcctggtgaatttgtgcgtagtattattggtttagatataaacgcggccaagaaagcctttagtaagtatttagatacagttccactcaataaacagcagatatattttatcaatgaaattattgaatatattgttaaaaatggaacattaactgatatgcatgtattacaggaatctccatttacaaatcaggggtcaatctcggaactctttgaatcagatataactatctggttcaaagtgaaaacagcaattgatgaaattaatagtaatgctggagtaggcgcagcttaa

SEQ ID NO: 100 - protein, 1113 aa, Lactobacillus johnsonii
MLSVTNFDYLLEEPQFKDFVQIAIAAEKVAVIDPATSVIDCRRAMELAVKWMYSVDSDLKTPYQDKLVTLINTLDFKDIVDPNTWQGLELIRRLGNVAVHTNRKVSLDEAILCLKALFSFFDMLDYCYGSNYQKKDFDKSIVGNYRLEFIPKVSPIEESTISLEKLTKKNESLQESLTAQRKAQEESYTPKPFGISEFKTRKIYIDTMLAEAGWIEGQNWLNEVELKGMPNKTGKGYADYVLYDDAHLPLAVIEAKKTCKDVAVGRQQAKLYADILENKYGRRPVVFLSNGFETRIIDNQYPERQVSSIYSKRDLEKLFNLQKVRQPLTNIVVDDNIAGRYYQKAAIQAVCESFSKENRRKALLVMATGSGKTRTAVGLVKVLLNAGWIKHVLFLADRDALVTQAKRSFVNLLPDLSVTNLVEDKKNYNARCVFSTYATMMNVIDTAIDDEKQKLYTAGHFDLIIVDEAHRSIYNKYRNIFTYFDAPLVGLTATPKDDIDKNTYSIFNLEDGVPTYGYDLAQAVDDGYLVPYKSIETHLKFMEKGINYDDLSDQEKEEYEETFTDEDGELPKKIESGKLNKWLFNKDTIRKVLNILMSQGLKINYGERIGKTIIFAKNHRHAEEILKVFNEEYPQFCKNGHGQPYATVIDNYTNYSQSAIDEFSDPNKLPQIAISVDMLDTGIDVPECLNLVFFKKVMSKAKFFQMIGRGTRLCPNLLDGKDKKEFYIFDFGDNFQFFRMEKGHEAGVQETLQSALFNLKMELVRKLQEAPYQTEDFKQYRKSLIEDLSKKVKELNRKNFAVKQHLAYVDKFSQIDNYNNLTYEDIVNVQKELAPLILPDNDEPNALRFDALVYKMELAKMSQESYGRLKVDLCNKISKLSDLMTIPQVKAKAELIKGILEPEYVESTNVQDLEHIRQNIRDLIQYLPKKGVVYYTNFTDTILDSTIHDAELETDTLKNYKAKAEFYIKQHQSENLMCKIRDNEPLSSEDLRELEDILWQKLGSKEEYQKEIGDKTPGEFVRSIIGLDINAAKKAFSKYLDTVPLNKQQIYFINEIIEYIVKNGTLTDMHVLQESPFTNQGSISELFESDITIWFKVKTAIDEINSNAGVGAA

SEQ ID NO: 101 - DNA, 3111 bp, Lactobacillus johnsonii
atgaaattaccaatcacaataacacaagttgcacaacagcctaaaatattgcctttaaataagatcatcaagagtagtgattttacgattaagcaattgaacccaaatactgtcatctcaaaggaagatgaaaatataagaccgactgaggtaggaaccatagtggattatctttctcgctatgtgttgcttgctgatgaacacgcctttgacgttgcgaatgctaaagccaaacaagatttgattcatggaattattccagttaaagaatataagaagcttttagatcaagaagaaagattaagatatttagttaaagatctgtcagatgttgattcattatcagatgaagctatttacttggcaacagacatctgtgcgtgggaagatgcatttcgcagtggtcgctatgttaaacccaaagcacatcctgataagttaacaattgaacacattaaaatgatgattcaacgtgttgaggaattctttgaagagtttggttggcctattagggatgcattttttgctaagactgagaatggctttgtctctggagatggcgactatcttttaaagcatacgttgttagatttaaaagtttcagtgcaaactactatgcaaatttcttgggttcgccagttgcttttatattatacgttaggattttataatcattttaataatgaaaatattgaacgattaatgattttcaacgcaagaacaaatactgtattttttattgatattgttaatattgatcagtccgtctttgaatttgtttacgatgcagctcataatatggtggctaactatattgctttagatagcacacaacacggtattattgtgttacgtccatatcaaattcatgcaattcaagccatttttgatgcatcatacgggaaagataataaggatcaaccacattctggttttgtttggcatacaacaggttctggtaagactttaaattcttataaagttgcacataatttactgaaaattccatcaattcaaaaaacgatattcctaatcgatcgtaatgatttagatacccaaactactcaagcatttgagacttatgctcagaacgactcaattgacgttgagggtactgaaaatagttattctcttgcccgtaaattagtaagttcggataaaagggttattgttactactagacaaaaaatgcaggcattattcaagcgaattgctcaggatcaagaacaaaaaagtctataccgtaagttaaaagatgtaaaattagcctttatcgttgatgagtgtcaccgtgcagtttctcctgatcaaaagaatgaaatagatgcgttttttactaaaaatccacctttatggtatggctttactggtactcctgtttttgcagaaaatgctcgtgaggctaagggaaagaatgctcgaactactgaacaacaatatggaaaatgcttgcataaatataccattaaggatgctatcagagataaagctgtacttggttttcaagtagaggaggaaagtaatgtgtcagaggatgctgacgaatcaggtactgatgctagaaataaagaatatgcatccctctcgcacatgaaggcagtagtaaaaagaattctaaataattcatatcgcaaattaggtatttataacaaagataatcgtggctacacctacgatgccatttttactactagctctattaagcaagctcaaaaatattatcgaatctttagggatgtaattaatgataaagatccagatattaaaattcctaatcgaattaagaaagtattgccagattttcctaaaatagcaattacatactcgattggcgaaaatggtgatggcgatgaggctaaccaaaatgagatgaagcaatctttagaagattacaataagatgtttaatactcattattctatggctgagttaggcgcatataacacaaacgtgaatgatcgtttagctcgtaaaaaagatgagtttaaaccacgttctcaacaattagatattgtcatagtagttgatcgtctgttaaccggctttgacgcaccatgtttatcaactttattcttggatcgtgcaccaatgccgtataaggatttaatccaagcattttcaagaactaaccgtatttttgatagagataaaagatatggacaaatagttacttatcaatatcctaagaaatacaaagaaagcatcaatggtgccttgatgctttataccgaaggtagtgaaaaacaagctcttgctccgacttgggatgaatcaattctacagttcaataatgctgaaaagaagatcattaagtatcagggagatcaaggtattccaattactgaagctccgcttgatgatcaaaaacgatttctaaaagaatatcaggattttgataaaagcttaggtgctatcaaaacttacaatgaattcaataatattgatcttgaaaaagattatggcttagatccaatgttcattgaggatacccgggcgacatatgaagttgttaaagaaaaggttagagaagctacaggtaaggataagccagcaacagaagatgatgatcagttcgatccagattatgagcttgaaaatactggtagacaagagattaattatgcttatattgttcaattgattcaggcttatattccatcagatgataaaggaaacagtaagcgaactaaggctgaagtaaaagaaatcgatgactatatcgaaaatctaggtaagaacaataagtcattggctgatattgtaaataatttatggtttcaaattaaatttgatcctgaaaagtttagaaataagcaagttaacgaactcttacaaaatatgatcgatgatgctagagaagatctaattaaaaagttcgctgatgaaaatggacttaatattgatgatctaaaatttgttattcgtcactatgacccaaatgaagttgatcatcaacaaacgggaattaatgctttactatcatttaaagtgtttagtggatttcgtaaaacacatcctgatatgaacatgttgcaatggaagaaaaaggttcgcttaggattgaataagttctataaggagcagatttcaccattggagaatagagattaa

SEQ ID NO: 102 - protein, 1036 aa, Lactobacillus johnsonii
MKLPITITQVAQQPKILPLNKIIKSSDFTIKQLNPNTVISKEDENIRPTEVGTIVDYLSRYVLLADEHAFDVANAKAKQDLIHGIIPVKEYKKLLDQEERLRYLVKDLSDVDSLSDEAIYLATDICAWEDAFRSGRYVKPKAHPDKLTIEHIKMMIQRVEEFFEEFGWPIRDAFFAKTENGFVSGDGDYLLKHTLLDLKVSVQTTMQISWVRQLLLYYTLGFYNHFNNENIERLMIFNARTNTVFFIDIVNIDQSVFEFVYDAAHNMVANYIALDSTQHGIIVLRPYQIHAIQAIFDASYGKDNKDQPHSGFVWHTTGSGKTLNSYKVAHNLLKIPSIQKTIFLIDRNDLDTQTTQAFETYAQNDSIDVEGTENSYSLARKLVSSDKRVIVTTRQKMQALFKRIAQDQEQKSLYRKLKDVKLAFIVDECHRAVSPDQKNEIDAFFTKNPPLWYGFTGTPVFAENAREAKGKNARTTEQQYGKCLHKYTIKDAIRDKAVLGFQVEEESNVSEDADESGTDARNKEYASLSHMKAVVKRILNNSYRKLGIYNKDNRGYTYDAIFTTSSIKQAQKYYRIFRDVINDKDPDIKIPNRIKKVLPDFPKIAITYSIGENGDGDEANQNEMKQSLEDYNKMFNTHYSMAELGAYNTNVNDRLARKKDEFKPRSQQLDIVIVVDRLLTGFDAPCLSTLFLDRAPMPYKDLIQAFSRTNRIFDRDKRYGQIVTYQYPKKYKESINGALMLYTEGSEKQALAPTWDESILQFNNAEKKIIKYQGDQGIPITEAPLDDQKRFLKEYQDFDKSLGAIKTYNEFNNIDLEKDYGLDPMFIEDTRATYEVVKEKVREATGKDKPATEDDDQFDPDYELENTGRQEINYAYIVQLIQAYIPSDDKGNSKRTKAEVKEIDDYIENLGKNNKSLADIVNNLWFQIKFDPEKFRNKQVNELLQNMIDDAREDLIKKFADENGLNIDDLKFVIRHYDPNEVDHQQTGINALLSFKVFSGFRKTHPDMNMLQWKKKVRLGLNKFYKEQISPLENRD

SEQ ID NO: 103 - DNA, 2325 bp, Lactobacillus kefiranofaciens
atggacttagaaaaaatgaatttatcagaagaagatattaaaaatagatatatttcaccggctatatttgatcatactggttggagaaaagcagatgctagaatggaatattcttatacagatggccagattaatgtagtggacgatgtagccacacgcggtaagaaaaagagaatagattatcttttgtactataagcctaattatccaatagctgtggtcgaagctaaggatagaaaaaagcatcctgcaccaggtgcaggtttgcaacaaggaattgggtatgctcgtgatttagatgttccgtttgtatattcttctaacggggatgcttttgttgagcatgatatgattaccggcaaggaaaaaacaatttctttgaatgattttcctactaaggatgagctttggactagatataaagaagaaaaacagccatctgaagaacaaattaagattataaatgagccatacttttcatctcgagaagtttattctccacgttattatcagcaaaatgcagtaaatagaattataaataagattgttaatggtgctagaagggtactattagtgatggcaacaggtactggtaagacttatactgcttttcaagtagtgtatcgtttactcaatgcaggagttaagcatcgtgtcttatacttagctgatcgaaatattttagttgatcaggcaatgacagatgattttaatcctttatcaaataaaattactaaggtacaaggtggtaagatggacagttcttatccaattcattttgctttgtatcaacaattggctggcaaagatgaggaggagggacatgagccttttagacaatttaaacctgatttctttgatttagttgtaattgatgaagcccatcgtggttcagctaaaaaggatagtcaatggcgtaagattcttgattattttgatggaccaaatgtaacccatttaggtatgaccgcaactccaagaaatgataaagacggatctaatattgcttactttggtgaaccggtttatacatattcattaaagcaaggaattgaagatggatttttagctccatataaggtaattagagtaaatcttgatattgatataaaaggattttggcctaaaaagaatgaaaaagataagcttggacaggttattaaaaataaacagtatacgtcacgagattttgatcgaacaatgattattgaacaacgtactaaagaagttgccaaatatgttagtgattaccttaaacaaagaaatgctcgttgggataaaactattctcttttgtgaagatactgagcatgctgagcgaatgagagaagagttaatcaatcaaaatagtgatcttgttgctcaaaatgataaatatgtgatgagaattacaggtgatgatatagaaggtaaaaagcagctagataattttgaaaatgtgactagcaaatatccaacccttgttacaacttcaaaattattaactacaggagttaatgttaaaacttgcaaaataattgttttggattctaatattaatttaatgactgaattcaagcaaattattggtcgcggtactagattggatccgtcacacggaaaagaatactttacaattattgattttcgtggagtttcgcggttatttgcggatcctgaatttgatggagaacctattgagataattaatggtggtactggcagtggtacgacaggtgttccttatcctcatactcattgtggtggttgtgtaggcgaaggttcacaacatcctaagtatgtagttgatcatgaggtaaatgttgtaggggatgagactcaatatttagatgaacatgggaatcttattactacatctttgacggattacactaagaagaatattttaggaaaatatgcaactcttgatagttttttgactgagtggaatgatgcagaaaagaaacaagttttacttaatgaattagagaagcatgggattttgtataaagagttgatgaaagaagagaatattaaggatatggatccttttgatttgattgttcatcttgcttataatcaaaagccgttaactaaatctgaaagagtaaataatgttaagaaatctgggattcttgataaatatcagggagctgctcgtgaaattttgaatactttacttgaaaagtataagaatgatggtattgctgatttggaaagtaatcaggtattaagtttgcctgaatttgataagttcggtggtgcaattaaaatcattatgacttttggtggcaagaaaaattatgaaaacacaattaaagaaataaagaatagaatctatagttaa

SEQ ID NO: 104 - protein, 774 aa, Lactobacillus kefiranofaciens
MDLEKMNLSEEDIKNRYISPAIFDHTGWRKADARMEYSYTDGQINVVDDVATRGKKKRIDYLLYYKPNYPIAVVEAKDRKKHPAPGAGLQQGIGYARDLDVPFVYSSNGDAFVEHDMITGKEKTISLNDFPTKDELWTRYKEEKQPSEEQIKIINEPYFSSREVYSPRYYQQNAVNRIINKIVNGARRVLLVMATGTGKTYTAFQVVYRLLNAGVKHRVLYLADRNILVDQAMTDDFNPLSNKITKVQGGKMDSSYPIHFALYQQLAGKDEEEGHEPFRQFKPDFFDLVVIDEAHRGSAKKDSQWRKILDYFDGPNVTHLGMTATPRNDKDGSNIAYFGEPVYTYSLKQGIEDGFLAPYKVIRVNLDIDIKGFWPKKNEKDKLGQVIKNKQYTSRDFDRTMIIEQRTKEVAKYVSDYLKQRNARWDKTILFCEDTEHAERMREELINQNSDLVAQNDKYVMRITGDDIEGKKQLDNFENVTSKYPTLVTTSKLLTTGVNVKTCKIIVLDSNINLMTEFKQIIGRGTRLDPSHGKEYFTIIDFRGVSRLFADPEFDGEPIEIINGGTGSGTTGVPYPHTHCGGCVGEGSQHPKYVVDHEVNVVGDETQYLDEHGNLITTSLTDYTKKNILGKYATLDSFLTEWNDAEKKQVLLNELEKHGILYKELMKEENIKDMDPFDLIVHLAYNQKPLTKSERVNNVKKSGILDKYQGAAREILNTLLEKYKNDGIADLESNQVLSLPEFDKFGGAIKIIMTFGGKKNYENTIKEIKNRIYS

SEQ ID NO: 105 - DNA, 2874 bp, Lactobacillus plantarum
atgatggcaagtggacatcaatctgaggcggaattagagaatcacctcattcgaaagttgcaaagcattggctatcattacgttgaaattcccgatgttgaaacgctaaacgcgcattttcgcgcggtcttgagtgaacgtaatcaagaacgtttaaagggaacaccactgagtgaccgtgaatttcaggccgtattaaatgatttgattggcgctaagacgcattatcaagttgcccaaattttacgtggttcggttgttcagccaactgggaaaattaatattaaacgtgatgatgatagcagcttatacctagaaatttttaatggaaaacaatttgatcagaatatttttgaagttagccatcaaatgacggttgaaggtcgtcatgagaaccgctatgatgtgctgatcttgatcaacgggatgccaattgcccaaattgagttgaagcggcaaggggttgaatttacccaggcttttaatcaaattattcgctaccgaactgaatcgtacgcacaagcaaaactcatgcgactggttcaggtatttgtcatttccaatggcaatgaaacgcggtattttgcgaatggcgatggtgagttaaattcaaacttcatgttctactggacggatgaacataataactggttgaatgacttggacgcttttacgaccactttcttgagtaaaccacggttacatagtttaatcgcaaaatatacggtgttcgatagtagtgaccataaaatgttattaatgcgcccttatcaaatatatgccactgaggcaattattaagcaagctatcgaccacccccatgaaaatgggtatgtgtggcacacgacgggttctggtaagacgattacctcctttaaggccagtcagttgttattacaagaaacggatgctgaaaaggttatcttcatgattgaccgtgctgacttggatattcagacggtaaagaattttagtgcctatctgcctgaaacaactgggggccagagtcccttggatcggactgacaatactgctgcattagtcaagcagctgtcctctaatgataatggcttaatcgtgacgaccattcagaagatgaataatgcggtctctaatgatcggtataaagatattctgacaccgtaccatgaccgcaaagtaatcttcattgaagatgaaagccatcgtagccagatgggtgaaatgcgaaaaaacgtgaaccattggtttaagaatgcccaacacttcgggttcacaggaaccccgatttttcaacagaacatgggacccgatgggcggaccacaaaagatctgtacgagaatcagttgcatcaatacttgattcgtgatgcagttcgtgatggtaacgtgcttggcttttcgattcagtatctgtcgacctttgaagagactgaccatgacattacagacgaacaagtaccaggaattgatacgcaagaggtctatgagtccgaggagcgattgaccaagattgtcgagcatatcttgttgaaccatagccacattacaaagaataagcattacaatgcgatctttacggtagcgaatacacgcatggctctaaagtactatcagttgtttagaaggttggaccctgatcataatttgaaggtcacgacaatctttacgtgggctgccaatgaggacgacaacgaggaacaccaaaaacaggatgatgtcacttcacggatgggattagatcaagtcgtgaaggactataatcaaatgtacggtacggatttttcaacggataaattcaaagattattttgcggatgtttctaagcggatgcgcgatcataatgaccaaacgccgacggataatattgatattttgattgttgtgaacatgttcctaactgggtttgactccaaacggttgtccacactatacgtggataaaaatttgcaatggcacggtttaatccaagcattttctcgaaccaatcgtgttgagggcaaacaaaaaccattcggaaatattattgcttatcgcaatatcaaaaataagacggatgaggctgtagcgttgttttcagacggggacagttccggcttcttagcaccagattatgatgaattaaaagctgaatttactgacaagattggccaattactgacggtgactccagatgtccagtcagtggacgacctctataaccgaggcgatgacgcactatatgagtttgtgatggcgtttcgggcggtcctccgggtatataatcgtattcgcgtgtatgatgattttgaatgggcgcaatatgaacctgaattttcggatcagctgatggaagcctttcggggcaaatattttacggcgtatcaaacgatttatcaacgcaaaacgcaggagcgcgtctcaatattagatgacgttgactttgatatcagtctattggagactgataccatcaatgttgactatattgtgaacttaatctcaggcattgacttaatgtcgtcgaccgaacgtaagcaagatattcagaaaattgaacatttgttggataatgcgaccaatgaccaattaaagtcgaaggttgaattgttggaacaatttttgaatgaagttttgccaacgctcgatacagacgatgatatcggcatgtcgttgagtaactttatggccgagagccagcgagctgccattaagggcttttcacaagaacaccacctttcggaagacttcgttaacgagcagatttctgactacaacttctacggtaagaccaaggacaaagagattattgacaagttaagtgctaatgggctcggctttcgagagaaacggcaggccaaacgcgagattaaggattttgtatcgactatcgaccgaaagtattcactaagctag

SEQ ID NO: 106 - protein, 957 aa, Lactobacillus plantarum
MMASGHQSEAELENHLIRKLQSIGYHYVEIPDVETLNAHFRAVLSERNQERLKGTPLSDREFQAVLNDLIGAKTHYQVAQILRGSVVQPTGKINIKRDDDSSLYLEIFNGKQFDQNIFEVSHQMTVEGRHENRYDVLILINGMPIAQIELKRQGVEFTQAFNQIIRYRTESYAQAKLMRLVQVFVISNGNETRYFANGDGELNSNFMFYWTDEHNNWLNDLDAFTTTFLSKPRLHSLIAKYTVFDSSDHKMLLMRPYQIYATEAIIKQAIDHPHENGYVWHTTGSGKTITSFKASQLLLQETDAEKVIFMIDRADLDIQTVKNFSAYLPETTGGQSPLDRTDNTAALVKQLSSNDNGLIVTTIQKMNNAVSNDRYKDILTPYHDRKVIFIEDESHRSQMGEMRKNVNHWFKNAQHFGFTGTPIFQQNMGPDGRTTKDLYENQLHQYLIRDAVRDGNVLGFSIQYLSTFEETDHDITDEQVPGIDTQEVYESEERLTKIVEHILLNHSHITKNKHYNAIFTVANTRMALKYYQLFRRLDPDHNLKVTTIFTWAANEDDNEEHQKQDDVTSRMGLDQVVKDYNQMYGTDFSTDKFKDYFADVSKRMRDHNDQTPTDNIDILIVVNMFLTGFDSKRLSTLYVDKNLQWHGLIQAFSRTNRVEGKQKPFGNIIAYRNIKNKTDEAVALFSDGDSSGFLAPDYDELKAEFTDKIGQLLTVTPDVQSVDDLYNRGDDALYEFVMAFRAVLRVYNRIRVYDDFEWAQYEPEFSDQLMEAFRGKYFTAYQTIYQRKTQERVSILDDVDFDISLLETDTINVDYIVNLISGIDLMSSTERKQDIQKIEHLLDNATNDQLKSKVELLEQFLNEVLPTLDTDDDIGMSLSNFMAESQRAAIKGFSQEHHLSEDFVNEQISDYNFYGKTKDKEIIDKLSANGLGFREKRQAKREIKDFVSTIDRKYSLS

SEQ ID NO: 107 - DNA, 2874 bp, Lactobacillus plantarum
atgatggcaagtggacatcaatctgaggcagaattagaaaatcacctcattcgaaagttacaaagcattggctatcattacgttgaaattcccgatgttgaaacgctaaacacacattttcgtgcggtcttgagtgaacgtaatcaagaacgtttaaagggaacaccactgagtgaccgtgaatttcaggccgtattaaatgatttgattggcgctaagacgcattatcaagttgcccaaattttacgtggttcggttgttcagccaactgggaaaattaatattaaacgtgatgatgatagcagcttatacctagaaatttttaatggaaaacaatttgatcagaatatttttgaagttagccatcaaatgacggttgaaggtcgtcatgagaaccgctatgatgtgctgatcttgatcaacgggatgccaattgcccaaattgagttgaagcggcaaggggttgaatttactcaggcttttaatcaaattattcgctaccgaactgaatcgtacgcacaagcaaaactcatgcgactggttcaggtatttgtcatttccaatggcaatgaaacgcggtattttgcgaatggcgatggtgagttaaattcaaacttcatgttctactggacggatgaacataataattggttgaatgacttggacgcttttacgaccactttcttgagtaaaccacggttacatagtttaatcgcaaaatatacggtgttcgatagtagtgaccataaaatgttattaatgcggccttatcaaatatatgccactgaggcaattattaagcaagctatcgatcacccccatgaaaatggttatgtgtggcacacgacgggttccggtaagacgattacctcctttaaggccagtcagttgttattacaagaaactgatgctgaaaaggttatcttcatgattgaccgtgccgacttggatattcagacggtaaagaattttagtgcctatctgcctgaaacaactgggggccagagtcccttggatcggactgacaatactgctgcattagtcaagcagctgtcctctaatgataatggcttgatcgtgacgaccattcagaagatgaataatgcggtctctaatgatcggtataaagatattctgacaccgtaccatgaccgcaaagtgatcttcattgaagatgaaagccatcgtagccagatgggcgaaatgcgaaaaaacgtgaatcattggtttaagaatgcccaacactttgggttcactggaaccccgatttttcaacagaatatgggacccgatgggcggaccacaaaagatctgtacgggaatcagttgcatcaatacttgattcgtgatgcagttcgtgatggtaacgtgcttggtttttcgattcagtatctgtcgacctttgaggagactgatcatgacattacagacgaacaagtaccaggaattgatacgcaagaggtctatgagtccgaggagcgattgaccaagattgttgagcatatcctgttgaaccatagccacattacaaagaataagcattacaatgcaatctttacggtagcgaatacgcgcatggctttaaagtactatcagttgtttagaaagttggatcctgatcataatttgaaggtcacgacaatctttacgtgggctgccaatgaggacgacaacgaggaacaccaaaaacaggatgatgtcacttcacggatgggattagatcaagtcgtgaaggactataatcaaatgtacggtacggatttttcaacggataaattcaaagattattttgcggatgtttctaagcggatgcgcgatcataatgaccaaacgccgacggataatattgatattttgattgttgtgaacatgttcctaactgggtttgactccaaacggttgtccacactatacgtggataaaaatttgcaatggcacggtttaatccaagcattttctcgaaccaatcgtgttgagggcaaacaaaaaccattcggaaatattattgcttatcgcaatatcaaaaataagacggatgaggctgtagcgttgttttcagacggggacagttccggcttcttagcaccagattatgatgaattaaaagctgaatttactgacaagattggccaattactgacggtgactccggatgtccagtcagtggacgacctctataaccgaggcgatgacgcactatatgagtttgtgatggcgtttcgggcggtcctccgggtatataatcgtattcgcgtgtatgatgattttgaatgggcgcaatatgaacctgaattttcggatcagctgatggaagcctttcggggcaaatattttacggcgtatcaaacgatttatcaacgcaaaacgcaggagcgcgtctcaatattagatgacgttgactttgatatcagtctattggagactgataccatcaatgttgactatattgtgaacttaatctcaggcattgacttaatgtcgtcgaccgaacgtaagcaagatattcagaaaattgaacatttgttggataatgcgaccaatgaccaattaaagtcgaaggttgaattgttggaacaatttttgaatgaagttttgccaacgctcgatacagacgatgatatcggcatgtcgttgagtaactttatggccgagagccagcgagctgccattaagggtttttcacaagaacaccacctttcggaagacttcgttaacgagcagatttctgactacaacttctacggtaagaccaaggacaaagagattattgacaagttaagtgctaatgggctcggctttcgagagaaacggcaggccaaacgcgagattaaggattttgtatcgactatcgaccgaaagtattcactaagctag

SEQ ID NO: 108 - protein, 957 aa, Lactobacillus plantarum
MMASGHQSEAELENHLIRKLQSIGYHYVEIPDVETLNTHFRAVLSERNQERLKGTPLSDREFQAVLNDLIGAKTHYQVAQILRGSVVQPTGKINIKRDDDSSLYLEIFNGKQFDQNIFEVSHQMTVEGRHENRYDVLILINGMPIAQIELKRQGVEFTQAFNQIIRYRTESYAQAKLMRLVQVFVISNGNETRYFANGDGELNSNFMFYWTDEHNNWLNDLDAFTTTFLSKPRLHSLIAKYTVFDSSDHKMLLMRPYQIYATEAIIKQAIDHPHENGYVWHTTGSGKTITSFKASQLLLQETDAEKVIFMIDRADLDIQTVKNFSAYLPETTGGQSPLDRTDNTAALVKQLSSNDNGLIVTTIQKMNNAVSNDRYKDILTPYHDRKVIFIEDESHRSQMGEMRKNVNHWFKNAQHFGFTGTPIFQQNMGPDGRTTKDLYGNQLHQYLIRDAVRDGNVLGFSIQYLSTFEETDHDITDEQVPGIDTQEVYESEERLTKIVEHILLNHSHITKNKHYNAIFTVANTRMALKYYQLFRKLDPDHNLKVTTIFTWAANEDDNEEHQKQDDVTSRMGLDQVVKDYNQMYGTDFSTDKFKDYFADVSKRMRDHNDQTPTDNIDILIVVNMFLTGFDSKRLSTLYVDKNLQWHGLIQAFSRTNRVEGKQKPFGNIIAYRNIKNKTDEAVALFSDGDSSGFLAPDYDELKAEFTDKIGQLLTVTPDVQSVDDLYNRGDDALYEFVMAFRAVLRVYNRIRVYDDFEWAQYEPEFSDQLMEAFRGKYFTAYQTIYQRKTQERVSILDDVDFDISLLETDTINVDYIVNLISGIDLMSSTERKQDIQKIEHLLDNATNDQLKSKVELLEQFLNEVLPTLDTDDDIGMSLSNFMAESQRAAIKGFSQEHHLSEDFVNEQISDYNFYGKTKDKEIIDKLSANGLGFREKRQAKREIKDFVSTIDRKYSLS

SEQ ID NO: 109 - DNA, 3117 bp, Lactobacillus reuteri
gtgtcaaaaggatacttattagaatctgatgtcgaaaatctggcattagatactctacaaaaagtaggctatgatgtttataaaagtccaagtacaacttctcctaatccagaaattgacaagatgcgaaataatgaccatgcggtagccgttttaactgaaaaactgcaggcgtccctaaaaaaacttaacccaggctatccagaggagatctataaagaggccttacgccagttaactcgcttggccgataatcctgatatgatggtgaacaatcactattttcataaattactaattgagggaattcgagttaaaacaacagttaatggtgaaaatcgaacagaagttctttatccaattgactttgaccatgtgggaaataaccaattcgtggcaacaaaccagtttacttttaagggtagtcatgaacggcgccctgatactactatctttattaatgggctaccagtggtgacatttgaatttaaagatgctagcaatcctaacgtcagtattgagaatgcttatcgacaattgcaaacttataaagctgagattcctgaatacctgaaatataatgaaattttgattgcatcggatggtattaattctcgagctggatctttaactgctggttttgatcgctttatgcgctggcgagcacccaaaaatattaacgttggtgatgaccttgaattagaaacaatgattaagtatatgctgacacctaaggatttacttaatctaattgagaacttcattatttttgaaactgatggtgataatacaattaagatcctagcggcttaccaccagtactacatggttaacaaagcggttaaagctgctaaaagaacgatggctgaccctaatgacaaacgcatcggggtagtttggcatactaccggttcagggaaaagtttatcgatggtgttctttgctagtattgtggctagaaaacttaataatccaacaatgctggtaattaatgaccgtaatgatctagatgaccaattgtttgatacctttgctgctgcacatgaatttttacggcaagctccagaacatgcagaatcacgtgatgaacttcgtaaatttatggataagcaagcgggggaaattatcttttcaaccattcaaaagttctcacccgacttcgaaagtggagaaactgaaatgccagttttgactaatcggagtgatgtaattgttattgcggatgaagctcaccgaactcaatatggcttgaaggctaagtttactaataatggactacgttatggatttgctaagtacttacgtgacgctttgcctaatgcttcattcattggttttactggaaccccaatttctactgctgataaatcaactgttgcagtctttggtaattacattgatgtttatgatattactcaggccgttaatgaccacgccacagtaaaaatctattacgaaagtcatgtattccctctgaagttgaagtccgatgcacaggctaagtatcaacaactgctaaaagaggccaacttagatgatgatcctaacttagaagaaaatactcgacgtaaccgagaattctccagtttggaggcattagctggtgctcagccgcgactagaaagtattgctaagcattttgttaatcatttcgaagcacgacaaaaagagacttttggcaaggcaatgattgttgaaatgtcgcgtcgtaacgcagttcgtctctataatcaaatcatcaagttacgcccagagtgggatagtgatgaccttaataaagggaaaatcaaggttgtaatgacgtcttctgcggccgatggtccagaaatggcaaagtttcagaccagtaaagctgatcgtcgagtccttcaaaaacggatgaaagataataatgatgaattacagattgttatcgtggttgatatgtggttgacaggttttgacgtaccttcgatgaatactatgtacattgataagccgatgaagggacacaatttaattcaagctattgctcgtgtcaaccgggtctttaaggacaaagatagtgccttaattgtggactacattggtatcgctgaaaatctgaaagaagcgctgaacgtttattccacagaagaccaggggcaagtgggtatcaatatgcaaaaagccctagcccttttgaaagagaaatatgacatcattactaatgatttcctatatggagttgattactcagggtttgattcagaagatggagctgttcgcttaaagattactcggcgagttgctaacgagattctaggtgaggacgaggaaacacaacaaaagtttttggatgttgtgactgaattacagaaagcttatgctttgacttcaactcaaccggaagcgcaagcctatggcaaagagattgctttctttaagacggttaaggtgtttattcaaaaactaaagcaaccaactacgcctgtcggttcaggaaaacatactgatgttaaatatcaaatgcaacagttattggatcagtccatcatttctgaacccaatgttgacatctacaatgaactaggcataaaaagacaaagtattgatttgatttcagatgaattcttgcagaaagttaatagtatgccggagcaggatgttgcaattaccctgttggaaaaattgcttaagggtaagattaaagcaatgatgaaaagtaataaagttacgtccgaaaaatttgaagatatgctccagaaatcaattgacgaatataatcaacgtgggattactagtgaaattgttatccgtaagttgattgatatggctaaaaagattaatgcagagcaagaaaagggtaaggacttagggctcagtcaagaagagatcgccttttatgatgcattagctgatcataagaaagcggtcgaagttcttggagaaaagaaacttcatttgattgctcaggagctagtcaagctagttaaagaagaagctggcgttgattgggaaaagagacgtaatattcaagctaaaatgcgtgtagctgtaaaacacctgcttagaaagtatggttatccacctgatattgctccggaagcagtcaataccgtggtagaacaagcagaattgatggcaacgaatgattaa

SEQ ID NO: 110 - protein, 1038 aa, Lactobacillus reuteri
MSKGYLLESDVENLALDTLQKVGYDVYKSPSTTSPNPEIDKMRNNDHAVAVLTEKLQASLKKLNPGYPEEIYKEALRQLTRLADNPDMMVNNHYFHKLLIEGIRVKTTVNGENRTEVLYPIDFDHVGNNQFVATNQFTFKGSHERRPDTTIFINGLPVVTFEFKDASNPNVSIENAYRQLQTYKAEIPEYLKYNEILIASDGINSRAGSLTAGFDRFMRWRAPKNINVGDDLELETMIKYMLTPKDLLNLIENFIIFETDGDNTIKILAAYHQYYMVNKAVKAAKRTMADPNDKRIGVVWHTTGSGKSLSMVFFASIVARKLNNPTMLVINDRNDLDDQLFDTFAAAHEFLRQAPEHAESRDELRKFMDKQAGEIIFSTIQKFSPDFESGETEMPVLTNRSDVIVIADEAHRTQYGLKAKFTNNGLRYGFAKYLRDALPNASFIGFTGTPISTADKSTVAVFGNYIDVYDITQAVNDHATVKIYYESHVFPLKLKSDAQAKYQQLLKEANLDDDPNLEENTRRNREFSSLEALAGAQPRLESIAKHFVNHFEARQKETFGKAMIVEMSRRNAVRLYNQIIKLRPEWDSDDLNKGKIKVVMTSSAADGPEMAKFQTSKADRRVLQKRMKDNNDELQIVIVVDMWLTGFDVPSMNTMYIDKPMKGHNLIQAIARVNRVFKDKDSALIVDYIGIAENLKEALNVYSTEDQGQVGINMQKALALLKEKYDIITNDFLYGVDYSGFDSEDGAVRLKITRRVANEILGEDEETQQKFLDVVTELQKAYALTSTQPEAQAYGKEIAFFKTVKVFIQKLKQPTTPVGSGKHTDVKYQMQQLLDQSIISEPNVDIYNELGIKRQSIDLISDEFLQKVNSMPEQDVAITLLEKLLKGKIKAMMKSNKVTSEKFEDMLQKSIDEYNQRGITSEIVIRKLIDMAKKINAEQEKGKDLGLSQEEIAFYDALADHKKAVEVLGEKKLHLIAQELVKLVKEEAGVDWEKRRNIQAKMRVAVKHLLRKYGYPPDIAPEAVNTVVEQAELMATND

SEQ ID NO: 111 - DNA, 3126 bp, Lactobacillus reuteri
gtggcaagttatcttaacgaagaaaatatagagggcattgctttaagatgtcttgatgaagtaggctatcaagtctacaaaagtgctagttatactagtccgaatgcagaaatagatgctgaaagaaataatgaccatacacaacctattttaaaaggacaattagaaaacgccttacgcaagttaaattctggacttgatgatgaagtataccgtaatgctattcatcaattcgagatgctagcagatagcccagatatgatgcttaataatcataagcttcatgaattaattatcggcggagcaaaagtaaaaacatcaattaaaggtgaggaccggaccattactttgtatccgattgattttaaaaacgttgataacaatacatttgttgcaacaaatcaatttacaatgaaacaaggagaacatgaaagaagaccagacattactctttttattaatgggcttcctttagttacatttgaattaaagaacccagcaaatgcgaatgtaggtattcaacaagcttttgcccaattttctacttataaagaagagatatcttcttatatgcaatataacgaaattttaattgtttctgatggaattaatgcgcgagctgggtcattaacagcaggaattgatcgctttatgcggtggcgcgagccgaaaaatgtagatattgacgattcaatgatggaattagaaatattgataaaatacatgcttaacccatctgatttgttaaacatcattcagaattttattctttttgagagtgatggcgacaagacaatcaagattttagcagcatatcatcaatactatatggttaataaggctgtaaaaagaacatcaaaagtattggctgatcctgatgacaaacgaattggtgttgtttggcatacgactggttctggtaaatcattgtcgatggtcttttattctggaatagtagctcgtaaacttggtaatccaactattttagtaattaatgatcgtaatgatttagatgatcagttatttggtacttttgcggctgctcatgaatatctacaacaaaatcctgatcacgctgaatcacgaggagaagttcgtaaatatatgagtaagaattctggcgggattgtttttagtacaattcaaaaattctcaccaaactttgacgcaggtgaagaacatatgcctatacttacaaaccgttctaacgttatcgtaatagttgatgaagctcatcggtctcaatatggaatgcaggcaaaactaaccgataatggtattcgttatggatatgctaaatatttgcgtgaggctcttcctaacgcctcgtttattggttttacaggaacaccaataaatactgaagataaatctaccgtggcaatgtttggaaattacattgatgtttatgatattactcaagcagttaatgatcatgccacggtccggatttattatgaaagtcacgttttcccattaaagcttaaggacaatgcaattgatgaatatcaaaagttaattaaagaagctggtatcaatgacgatcctaatcttagggaaactgagcgacgaaatcgggcatttactagattagaggcccttgccggtgcaaaaccacggttagaaaaaatagcccaacactttgttcatcattttgaatcacgacaaaaggaagaatttggtaagtcgatgattgttgaaatgtcacgacaaaatgcagtaaagttatataatgaaattgcaaaattacgtcctgagtgggtaaatgatgatattcataagggaaaaatcaaagttattatgacgtctaatgcttctgatggcccagaatttgctaaatttaagacaagcaaacaagaccgatttacgttacaacaacggatgaaagataacgctgacgagttacaaattgtaatagttgttgatatgtggctaactggatttgatgttcctagcatgaataccatgtacattgacaagccaatgcaaggacataatctcatccaagcaattgctcgtgttaatcgggtgtttaagaataaagatagtgggctaattgttgattatattggaattgctgatgctcttcgttttgccttaaatatatacacaaaagatgatcaaggaaaaattggaattaatgttgatcgtgcattaatgctcctaaaagagaaatatgacattattaaagaagatttcctgtatgggatcgattactcagagtttgattctgatgatagccaaactcgtcagaaggcaattactcgtgttgtaaatgaattagctgcagaggacgatgaaacaaagcaaaaattctttgatgtagtaacagaacttcaaaaagcttatgcgttagtttcaactcagcctgaagcccaagatttaagtgcagagattgcattctttaaaacggttaaagtatttttaactaaacttgaggctcctgataatccagacgatagcaaggagattcatagctcagtcgattatcgaatgcaacagctattagatcaatcaattatttcggagccgaatgttgatatttatcgtgacctaggattagaacgccctaacttagatttaatatcagaacaatttcttgaaaaagtaaatgaaattactgagaaagatctagcaattactcttttagagaaactattaaaagggcaagtaaaagcctaccaaaaaacgaatattgttaaaggtaagaagtttgaggaattacttcaagagtcaattgatgattacaataagcggggaattaccagtgaaattgtaattagaaagttaattgatatggctaaagaaattaataaagaacaacaagaaggtaagaatctgggactttcaaaagaagaagtggctttttatgatgcactagctgatcatgagaaagctgttcaagaattaggagaagaaaaattacatcttattgctgctgaattagtaaagactgtaaagcaacaatcaggggttgattgggagcggcgcagcaatgttcgtgctaaaatgcgtgttgcagttaaacatctattacgtaagtacggttatccacctgatattgctccagatgcaattaagaccgtagtaaagcaagctgaacaaatggcttctcaagagagttaa

SEQ ID NO: 112 - protein, 1041 aa, Lactobacillus reuteri
MASYLNEENIEGIALRCLDEVGYQVYKSASYTSPNAEIDAERNNDHTQPILKGQLENALRKLNSGLDDEVYRNAIHQFEMLADSPDMMLNNHKLHELIIGGAKVKTSIKGEDRTITLYPIDFKNVDNNTFVATNQFTMKQGEHERRPDITLFINGLPLVTFELKNPANANVGIQQAFAQFSTYKEEISSYMQYNEILIVSDGINARAGSLTAGIDRFMRWREPKNVDIDDSMMELEILIKYMLNPSDLLNIIQNFILFESDGDKTIKILAAYHQYYMVNKAVKRTSKVLADPDDKRIGVVWHTTGSGKSLSMVFYSGIVARKLGNPTILVINDRNDLDDQLFGTFAAAHEYLQQNPDHAESRGEVRKYMSKNSGGIVFSTIQKFSPNFDAGEEHMPILTNRSNVIVIVDEAHRSQYGMQAKLTDNGIRYGYAKYLREALPNASFIGFTGTPINTEDKSTVAMFGNYIDVYDITQAVNDHATVRIYYESHVFPLKLKDNAIDEYQKLIKEAGINDDPNLRETERRNRAFTRLEALAGAKPRLEKIAQHFVHHFESRQKEEFGKSMIVEMSRQNAVKLYNEIAKLRPEWVNDDIHKGKIKVIMTSNASDGPEFAKFKTSKQDRFTLQQRMKDNADELQIVIVVDMWLTGFDVPSMNTMYIDKPMQGHNLIQAIARVNRVFKNKDSGLIVDYIGIADALRFALNIYTKDDQGKIGINVDRALMLLKEKYDIIKEDFLYGIDYSEFDSDDSQTRQKAITRVVNELAAEDDETKQKFFDVVTELQKAYALVSTQPEAQDLSAEIAFFKTVKVFLTKLEAPDNPDDSKEIHSSVDYRMQQLLDQSIISEPNVDIYRDLGLERPNLDLISEQFLEKVNEITEKDLAITLLEKLLKGQVKAYQKTNIVKGKKFEELLQESIDDYNKRGITSEIVIRKLIDMAKEINKEQQEGKNLGLSKEEVAFYDALADHEKAVQELGEEKLHLIAAELVKTVKQQSGVDWERRSNVRAKMRVAVKHLLRKYGYPPDIAPDAIKTVVKQAEQMASQES

SEQ ID NO: 113 - DNA, 3327 bp, Lactobacillus reuteri
gtgactaactttgattatttactagaagaaccacaatttaaagatttcgtgcaaatagcaatagcagctgaaaaagtagccgttattgatcctgcaacagcagtaattgactgtcgacgtgcaatggaattagcggttaagtggatgtattcagttgactcagacttaagaactccctatcaggataaattagtaaccttaatcaatactctagattttaaggatattgttgatcctaatacttggcaaggcctagaattaattcgtcgtttaggaaatattgctgtacacactaatagaaaagtatctctagatgaagctattttatgtttaaaagctttatttagcttttttgatatgcttgattattgttatggaagcaattatcaaaagaaagattttgacaagtcgattgttgggaattatcgtctggagtttgttcctaaagtctctccaatggaagagtcaacaatttctctcgaaaaacttacgaaaaagaacaaacctttacaggaatctttaactgcgcaaagaaaagtacaaggaaagagctatactcctaaaccatttggaatctcagagtttaaaactcgtaaaatttatattgatactatgctagctgaagtaggttggattgagggccaaaattggttaaacgaagtagaacttaaaggaatgcctaacaaagctggtactggatatgccgattacgtcttatatgatgatgcgcatcaacctcttgcagttattgaggcaaagaaaacttgtaaagatgtagcagttgggcgccaacaagcaaaactatatgcggatatattagagaataagtatggacgtagaccagttatatttttaagtaatggatttgaaacacgaattattgataatcaataccctgagagacaagtttcatcaatttattctaagcgtgatttagaaaagttgtttaatttgcaaaaagtacgccaacctttaacgaatattgtagtagatgataatattgcgggacgttattatcaaaaggctgccattcaagctgtttgcgaaagtttttcaaaagaaaatagacgtaaagctttattagtcatggcgacaggatccggtaaaacaagaactgcagttggattagttaaagttcttttaaacgctggttggattaaacatattttatttttagccgatagagatgctttagtgacacaggctaaaaggagctttgtcaatttactacctgatctttccgtaactaatttagttgaagataagaaaaattataacgctcgatgtgttttttctacctatgcaacaatgatgaatgtcattgatacagcaatagatgacgaaaagcaaaaactgtatacagcaggacattttgacttaattattgtcgatgaggctcaccgatcaatctataataaatatagaaatatctttacttactttgatgcaccattagttgggctaactgctacccctaaagatgatattgataaaaatacctattctatttttaacttggaagatggagtgcccacttatgggtatgatctagcagaagctgttaaagataagtgtttagtaccctacagatcaatagagacccgcttaaaatttatggaaaagggtattaattatgacgatttaactgatcaagaaaaggaagaatatgaggaaactttcacagatgaagatggtgagctgccaaagaagattgaatcaagaaagttgaataagtggttatttaataaagacactattcgcaaagctttgaatattttaatgagtcagggactaaagattaattatggcgaaagaataggtaaaactattatctttgctaagaatcatcgccatgctgaggaaattctgaaagtttttaatgaagaatatcctcagttttgtaaaaatggtcaaccttatgcaaccgtaattgataattatactaattacgcacaaagtgcaattgatgaattttcagatccaaataaattaccacaaattgctatttccgtggatatgttggacacaggaattgatgtaccagaatgtttaaatttagtatttttcaaaaaagtaatgagtaaggcgaaattcttccagatgattggaagaggaacacgtttatgtccaaatttgttagatggaaaagataaagaagaattttacatttttgatttttgcgataactttcaatttttccgtatgaaaaagggacgtgaagcgggggcccaagaaacgttacaaagtgctttattcaatttgaaaatgaaattagtacggaaattacaagaagccccatatcaaacagaagattttaagcagtatcgaaactttttagttgaagatttatctaaaaaagttaaagaattaaatagaaaaaattttgctgttaaacaacatcttgcctatgttgataaattttctcaaatagataattacaataacttaacttatgaggacattgtaaatgttcaaaaagagttagcacctctaattcttccggataatgatgaaccaaatgccctacgctttgatgctttagtctataaaatggaactggcaaaaatgtcacaagaatcctatggacgattaaaagtagatctctgtaataaaatttctaaattatctgatttaatgactatcccacagattaaagcaaaagccgacttaattaaagttatgtcagagtcagaatatgttgaatctgcaaatgttcaagatttagagcatatccgtcaaaatatacgggacttaattcaatatcttccaaaaaagggagtagtgtattatacaaatttcactgatagtatattagattcaactgttcatgaagctgaacttgaaacttctactttgaaaaactacaaagcagaagcagaattttatattaagcaacatcaaagtgaaaatataatgtgtaaaattaaagataatgcacctttaaatagcagtgatataaaagagctcgagaatattctatggcaaaaacttggaagtaaagaagagtatcaaaaagaaataggaaataaaactcctggtgaatttgttcgtagtattgttggtttagatatgaaagctgccaaagaagcttttaataaatatttagatacagtttcacttaataaacagcagatatattttataaatgaaattatagagtatattgttaaaaatggtacattaactgatatgcatgttttacaggaatctccatttacaaatcaaggatcaatttcagaactctttgaatcagataaaaatatttggttcaaagtaaaaagagcaattgatgaaattaatagtaatgctggagttggcgtagcttaa

SEQ ID NO: 114 - protein, 1108 aa, Lactobacillus reuteri
MTNFDYLLEEPQFKDFVQIAIAAEKVAVIDPATAVIDCRRAMELAVKWMYSVDSDLRTPYQDKLVTLINTLDFKDIVDPNTWQGLELIRRLGNIAVHTNRKVSLDEAILCLKALFSFFDMLDYCYGSNYQKKDFDKSIVGNYRLEFVPKVSPMEESTISLEKLTKKNKPLQESLTAQRKVQGKSYTPKPFGISEFKTRKIYIDTMLAEVGWIEGQNWLNEVELKGMPNKAGTGYADYVLYDDAHQPLAVIEAKKTCKDVAVGRQQAKLYADILENKYGRRPVIFLSNGFETRIIDNQYPERQVSSIYSKRDLEKLFNLQKVRQPLTNIVVDDNIAGRYYQKAAIQAVCESFSKENRRKALLVMATGSGKTRTAVGLVKVLLNAGWIKHILFLADRDALVTQAKRSFVNLLPDLSVTNLVEDKKNYNARCVFSTYATMMNVIDTAIDDEKQKLYTAGHFDLIIVDEAHRSIYNKYRNIFTYFDAPLVGLTATPKDDIDKNTYSIFNLEDGVPTYGYDLAEAVKDKCLVPYRSIETRLKFMEKGINYDDLTDQEKEEYEETFTDEDGELPKKIESRKLNKWLFNKDTIRKALNILMSQGLKINYGERIGKTIIFAKNHRHAEEILKVFNEEYPQFCKNGQPYATVIDNYTNYAQSAIDEFSDPNKLPQIAISVDMLDTGIDVPECLNLVFFKKVMSKAKFFQMIGRGTRLCPNLLDGKDKEEFYIFDFCDNFQFFRMKKGREAGAQETLQSALFNLKMKLVRKLQEAPYQTEDFKQYRNFLVEDLSKKVKELNRKNFAVKQHLAYVDKFSQIDNYNNLTYEDIVNVQKELAPLILPDNDEPNALRFDALVYKMELAKMSQESYGRLKVDLCNKISKLSDLMTIPQIKAKADLIKVMSESEYVESANVQDLEHIRQNIRDLIQYLPKKGVVYYTNFTDSILDSTVHEAELETSTLKNYKAEAEFYIKQHQSENIMCKIKDNAPLNSSDIKELENILWQKLGSKEEYQKEIGNKTPGEFVRSIVGLDMKAAKEAFNKYLDTVSLNKQQIYFINEIIEYIVKNGTLTDMHVLQESPFTNQGSISELFESDKNIWFKVKRAIDEINSNAGVGVA

SEQ ID NO: 115 - DNA, 3126 bp, Lactobacillus reuteri; identical to SEQ ID NO: 7

SEQ ID NO: 116 - protein, 1041 aa, Lactobacillus reuteri; identical to SEQ ID NO: 8

SEQ ID NO: 117 - DNA, 3090 bp, Lactobacillus rhamnosus
atggggatagaaagaaaagagcttgcgtttgaaagtaagctcattgatcatttgcagcatattggcggaactaagcagtggcagtatttaccagatataaaagatggagaagatctgtggcaaaatttcaaagtaattcttgagcggaataacgctgaccagttacaaaagccgctttcggttgcagaatttaatcaggtccaggctaaaattagaaacttacgctctccgtatgaagcaggacaatttctatacggtctaaacgggacttcgcagattgaagttgatcgcgatgatggtaaacatgttttcttaaccgtttttgaccaagctgaagttggggctggtaacacggtctatcaaattgttaatcagattcggcggccacctgttcaggcaggtcgaccagcgcgccggtttgacgttactctcttgattaacggcttaccgattattcagatcgaagagaaggctgacagtcacgatcctaaagaagccttaaaccaaatgcatcagtatatacatgaacgacagtacacggatatttttagtacgcttcagatattggtctccatgacgccgcatgatattcggtacatggccaacacaacagatgatatgtttaacctcgattttgcctttcgttggcagagagagtctgacaataagccaattcgtgattggcgcgagttttccaatcttatgttgtctattccgatggcacaccagatggcgactaattatatgatcctcgatggtactaaaaatcggaaaatgatcaaggttatgcgtccatatcaggtctatgccaccattcgcgttattaacaaaatcagacggcaacaatttggacttgatcctaaagaggtcggctatatttggcataccacaggatcgggaaagacaataagctcatttaaggcggcgtggctcgcttcacgtctaccaaatgttgacaaggtcgtctttttagttgatcgaattgcgttaaccaaccagactgtcgacgaatatcgtgcctatgatcctgatagcgatcccgatggcaaaaatggggtcgtagcagatacagccaataagatcgttttgaagcaaagattgaagacaaagcggtctggcattattgtgacttctattcagaaattggatggattggcacgaaataactttaaatttgataaaaatgttgtttttattgtggatgaggcgcatcggtcaacagccggcgaaatgattcagcacattaaagccgcatttcctaaatcggcgtgggtcggctatacgggcacgcctaattttgatgcaactaaaggcccaacaacttacgaaatctttggagaagtcttgcatgcgtacacgattcgagatgcaattgcggatcacaatgttcttggatttaaagttgactttgaaaccacattgaccgattcagctctgagagaatcgtatttgccgaaatactttgcttggcgatatcctgagtggccaaaagaaaaaattgaaaatagaattaacaacatgacggcagatgatatggatgatgccgttctaccatctgtttacgatggcaaccaagatcatatccgcttagtcgtgaaagatgtgctagataattggcagaaacgttctaacaattatgcttacaacgcgctatttactacccacgttggcggtcaacaatcatcaattaaaaatgcggtgagcttttacgaagagttcaagcgacagaatgctaagcgaaagcgtccattacgaattggcattacttttagcatggacacaacgaatagtagtacccagcaagaaactaatgacggtttacttgaagcgattaatgattataacgccgcttttggtgagcactttgatctaacaaacgtaaggggatactcagaggctgttgtgacacgtttaaataaaacggtagatgataaacgttactttgatttggtcattgtcgttgatcagcttctaactgggtttaacgccccagaactgaattgtctatatgtcgatcgtactctcaaaggggcaaatctgattcaagcttattcccggactaaccgcgtgcagaattttcagacaaaaccgtttggccggatcgtgaactaccgctggccaaatcagtcagaaaagttgatgaaggaagctattcaggtttatgccaatcgcgattctgcaaacgtgcagctcacaatgggtcctgatgatacatctggcgtgattgaaaaaagttacaacgatctcaaagatgaaatgaaaaagattgtcgaagaggcggccagtttaactggaaactttacaatgacaccgccgagtgaaagcgcccaagagcatttatataatttgctgcatgattacaatctcaccatggcaaaactcaagcaggatgacaaatatgacattgatcaccctgaaacactcttaagtcaaattggactgacacccgatcaagaaattcagctgacaaccgtcattgctggtgatttgaaagctagtattgctgaaaagcgaaatattgatatcagtgatctaacgctgcaaatggaacacgtgaaggacattcgcgtcacgtatgattatatttccgagctactggctgaacttgcgaataaagtgcatgacaatgatcaagaaggtagtactgccacgcgaacacaaattcaacaggctaccgagcagatggatgatgaacgctatgcaacaaacattcgcagcctagcagatgccttggtcagcggggaaaccaaggcggaacaatatccagtcaaggctaatgatgtgaagagcatgattaccaaccatattaaccagacaaagcggttgataattcgtgactttaagcaatggtggggtgtttctgatattccgtcagaccgcttgattaatcaaattgtggaagaacatacactcggcgaagatgatttaaatgccaccggagccttgaactcgattctcaaagagggtcaagcaacgtataagactgatgcaaaagatgaaaaagtgcgtcaattgtcgccgataaaatttagaaacaaattccgtcaagcctttgcagaatttgctgatcaatacaagaaacagttttag

SEQ ID NO: 118 - protein, 1029 aa, Lactobacillus rhamnosus
MGIERKELAFESKLIDHLQHIGGTKQWQYLPDIKDGEDLWQNFKVILERNNADQLQKPLSVAEFNQVQAKIRNLRSPYEAGQFLYGLNGTSQIEVDRDDGKHVFLTVFDQAEVGAGNTVYQIVNQIRRPPVQAGRPARRFDVTLLINGLPIIQIEEKADSHDPKEALNQMHQYIHERQYTDIFSTLQILVSMTPHDIRYMANTTDDMFNLDFAFRWQRESDNKPIRDWREFSNLMLSIPMAHQMATNYMILDGTKNRKMIKVMRPYQVYATIRVINKIRRQQFGLDPKEVGYIWHTTGSGKTISSFKAAWLASRLPNVDKVVFLVDRIALTNQTVDEYRAYDPDSDPDGKNGVVADTANKIVLKQRLKTKRSGIIVTSIQKLDGLARNNFKFDKNVVFIVDEAHRSTAGEMIQHIKAAFPKSAWVGYTGTPNFDATKGPTTYEIFGEVLHAYTIRDAIADHNVLGFKVDFETTLTDSALRESYLPKYFAWRYPEWPKEKIENRINNMTADDMDDAVLPSVYDGNQDHIRLVVKDVLDNWQKRSNNYAYNALFTTHVGGQQSSIKNAVSFYEEFKRQNAKRKRPLRIGITFSMDTTNSSTQQETNDGLLEAINDYNAAFGEHFDLTNVRGYSEAVVTRLNKTVDDKRYFDLVIVVDQLLTGFNAPELNCLYVDRTLKGANLIQAYSRTNRVQNFQTKPFGRIVNYRWPNQSEKLMKEAIQVYANRDSANVQLTMGPDDTSGVIEKSYNDLKDEMKKIVEEAASLTGNFTMTPPSESAQEHLYNLLHDYNLTMAKLKQDDKYDIDHPETLLSQIGLTPDQEIQLTTVIAGDLKASIAEKRNIDISDLTLQMEHVKDIRVTYDYISELLAELANKVHDNDQEGSTATRTQIQQATEQMDDERYATNIRSLADALVSGETKAEQYPVKANDVKSMITNHINQTKRLIIRDFKQWWGVSDIPSDRLINQIVEEHTLGEDDLNATGALNSILKEGQATYKTDAKDEKVRQLSPIKFRNKFRQAFAEFADQYKKQF

SEQ ID NO: 119 - DNA, 3090 bp, Lactobacillus rhamnosus
atggggatagaaagaaacgagcttgcgtttgaaagtaagctcattgatcatttgcagcatattggcggaactaagcagtggcagtatttaccagatataaaagatggagaagatctgtggcagaatttcaaagtaattcttgagcggaataacgctgaccagttacaaaagccgctgtcggttgcagaatttaatcaggtccaggctaaaattagaaacttacgctctccgtatgaagcaggacaatttctatacggtctaaacgggacttcgcagattgaagttgatcgcgatgatggtaaacacgttttcttaaccgtctttgatcaagctgaagttggcgctggtaatacggtttatcaaattgttaatcagattcggcgcccacctgttcaagcaggtcgaccagctcgccggtttgacgttacccttttgattaacggtttaccgattattcagattgaagaaaaggctgacagtcatgaccccaaagaagccttaaatcaaatgcatcagtatatccatgaacgacagtacacggatatctttagtacgctccagatattggtctccatgacgccgcatgatattcggtacatggccaacacaacagatgatatgtttaaccttgattttgcctttcgttggcagagagagtctgataataggccaattcgtgattggcgcgagttttccaatcttatgttgtctattccgatggcacaccagatggcgactaattatattatcctcgatggcactaaaaatcggaaaatgatcaaggttatgcgtccatatcaggtctatgccaccattcgcgttattaacaaaatcagacggcaacaattcggacttgatcctaaggaagtcggctatatttggcataccactggatcgggaaagacaataagttcatttaaggcggcgtggctcgcttcacgtctaccaaatgttgacaaggttgtctttttggttgatcgaattgcattgaccaaccagactgtcgacgaatatcgtgcctatgatcctgatagcgatcccgatggcaaaaatggggtcgtagcagatacggccaataagaccgttttgaagcaaaaattgaagacaaaacggtctggcatcattgtgacttctattcagaaattggatggattagcacgaaataactttaaatttgataaaaatgttgttttcattgtggatgaggcgcatcggtcaacagccggcgaaatgattcagcacattaaagccgcatttcctaaatcggcgtgggtcggctatacgggcacgcctaattttgatgcaacaaaaggcccaacaacttacgaaatttttggagaagtcttgcatgcatatacgattcgagatgcaattgcagaccacaatgttcttggatttaaagttgactttgaaaccacattgaccgattcagctctgagagaatcgtatttgccgaaatactttgcttggcgatatcctgagtggccaaaagaaaaaattgaaaatagaattaacaacatgacggcagatgatatggatgatgccgttctaccatctgtttacgatggcaaccaagatcatatccgcttagtcgtgaaagacgtgctagataattggcagaaacgttctaacaattatgcttacaacgcgctatttactacccacgttggcggtcaacaatcatcaattaaaaatgctgtgagtttttacgaagagttcaagcgacagaatgctaaacgaaagcgtccattacgaattggcattacttttagcatggacacaacgaatagtagtacccagcaaggaactaatgacggtttacttgaagcgattaatgattataatgctgcttttggcgagcactttgatctaacaaacgtaagagggtactcagaggctgttgtgacacgtttaaataaaacggtagatgataaacgttactttgatttggtcattgtcgttgatcagcttctaactgggtttaacgccccagaactaaattgtctatatgtcgatcgtactctcaaaggggcgaatctgatccaagcttattcccggactaaccgcgtgcagaattttcagacaaaaccgtttggccggatcgtgaactaccgctggccaaatcagtcagaaaagttgatgaaggaagctattcaggtatatgccaatcgtgattctgcaaacgtgcagctcacagtgggcccggatgatacatctggcgtgattgaaaaaagttacaacgatctcaaagatgaaatgaaaaagattgtcaaagaggcggccagtttaactggaaactttacaatgacaccgccgagtgaaagcgcccaagagcatttatataatctgctgcatgattacaatctcaccatggcaaaacttaagcaggatgacaaatatgacattgatcaccctgaaacacttttaagtcaaattggactgacacccgatcaagaaattcaactgacaactgttattgctggtgacttgaaagctaatattgccgaaaaacgaaatattgatatcagtgatctaacgctgcaaatggaacacgtgaaggatattcgcgttacgtatgattatatttccgaactgctggctgaacttgcaaataaagtgcatgacaatgatcaagaaggtagtactgccacgcgaacacaaattcaacaggctaccgagcagatggatgatgaacgctatgcaacaaacattcgtagcctagcagatgccttggtcaacggggaaaccaaggcggaacaatatccagtcaaagctaatgatgtgaagagcatgattaccaaccatattaaccagacaaagcggttgataattcgtgactttaagcaatggtggggtgtttctgatattccgtcagaccgcttgattaatcaaattgtggaagaacatacactcggcgaagatgatttaaatgccaccggagccttgaactcgattctcaaagagggtcaagcaacgtataagactgatgcaaaagatgaaaaagtgcgtcaattgtcgccgataaaatttagaaacaaattccgtcaagcctttgcagaatttgctgatcaatacaagaaacagttttag

SEQ ID NO: 120 - protein, 1029 aa, Lactobacillus rhamnosus
MGIERNELAFESKLIDHLQHIGGTKQWQYLPDIKDGEDLWQNFKVILERNNADQLQKPLSVAEFNQVQAKIRNLRSPYEAGQFLYGLNGTSQIEVDRDDGKHVFLTVFDQAEVGAGNTVYQIVNQIRRPPVQAGRPARRFDVTLLINGLPIIQIEEKADSHDPKEALNQMHQYIHERQYTDIFSTLQILVSMTPHDIRYMANTTDDMFNLDFAFRWQRESDNRPIRDWREFSNLMLSIPMAHQMATNYIILDGTKNRKMIKVMRPYQVYATIRVINKIRRQQFGLDPKEVGYIWHTTGSGKTISSFKAAWLASRLPNVDKVVFLVDRIALTNQTVDEYRAYDPDSDPDGKNGVVADTANKTVLKQKLKTKRSGIIVTSIQKLDGLARNNFKFDKNVVFIVDEAHRSTAGEMIQHIKAAFPKSAWVGYTGTPNFDATKGPTTYEIFGEVLHAYTIRDAIADHNVLGFKVDFETTLTDSALRESYLPKYFAWRYPEWPKEKIENRINNMTADDMDDAVLPSVYDGNQDHIRLVVKDVLDNWQKRSNNYAYNALFTTHVGGQQSSIKNAVSFYEEFKRQNAKRKRPLRIGITFSMDTTNSSTQQGTNDGLLEAINDYNAAFGEHFDLTNVRGYSEAVVTRLNKTVDDKRYFDLVIVVDQLLTGFNAPELNCLYVDRTLKGANLIQAYSRTNRVQNFQTKPFGRIVNYRWPNQSEKLMKEAIQVYANRDSANVQLTVGPDDTSGVIEKSYNDLKDEMKKIVKEAASLTGNFTMTPPSESAQEHLYNLLHDYNLTMAKLKQDDKYDIDHPETLLSQIGLTPDQEIQLTTVIAGDLKANIAEKRNIDISDLTLQMEHVKDIRVTYDYISELLAELANKVHDNDQEGSTATRTQIQQATEQMDDERYATNIRSLADALVNGETKAEQYPVKANDVKSMITNHINQTKRLIIRDFKQWWGVSDIPSDRLINQIVEEHTLGEDDLNATGALNSILKEGQATYKTDAKDEKVRQLSPIKFRNKFRQAFAEFADQYKKQF

SEQ ID NO: 121 - DNA, 3090 bp, Lactobacillus rhamnosus
atggggatagaaagaaacgagcttgcgtttgaaagtaagctcattgatcatttgcagcatattggcggaactaagcagtggcagtatttaccagatataaaagatggagaagatctgtggcagaatttcaaagtaattcttgagcggaataacgctgaccagttacaaaagccgctgtcggttgcagaatttaatcaggtccaggctaaaattagaaacttacgctctccgtatgaagcaggacaatttctatacggtctaaacgggacttcgcagattgaagttgatcgcgatgatggtaaacacgttttcttaaccgtctttgatcaagctgaagttggcgctggtaatacggtttatcaaattgttaatcagattcggcgcccacctgttcaagcaggtcgaccagctcgccggtttgacgttacccttttgattaacggtttaccgattattcagattgaagaaaaggctgacagtcatgaccccaaagaagccttaaatcaaatgcatcagtatatccatgaacgacagtacacggatatctttagtacgctccagatattggtctccatgacgccgcatgatattcggtacatggccaacacaacagatgatatgtttaaccttgattttgcctttcgttggcagagagagtctgataataggccaattcgtgattggcgcgagttttccaatcttatgttgtctattccgatggcacaccagatggcgactaattatattatcctcgatggcactaaaaatcggaaaatgatcaaggttatgcgtccatatcaggtctatgccaccattcgcgttattaacaaaatcagacggcaacaattcggacttgatcctaaggaagtcggctatatttggcataccactggatcgggaaagacaataagttcatttaaggcggcgtggctcgcttcacgtctaccaaatgttgacaaggttgtctttttggttgatcgaattgcattgaccaaccagactgtcgacgaatatcgtgcctatgatcctgatagcgatcccgatggcaaaaatggggtcgtagcagatacggccaataagaccgttttgaagcaaaaattgaagacaaaacggtctggcatcattgtgacttctattcagaaattggatggattagcacgaaataactttaaatttgataaaaatgttgttttcattgtggatgaggcgcatcggtcaacagccggcgaaatgattcagcacattaaagccgcatttcctaaatcggcgtgggtcggctatacgggcacgcctaattttgatgcaacaaaaggcccaacaacttacgaaatttttggagaagtcttgcatgcatatacgattcgagatgcaattgcagaccacaatgttcttggatttaaagttgactttgaaaccacattgaccgattcagctctgagagaatcgtatttgccgaaatactttgcttggcgatatcctgagtggccaaaagaaaaaattgaaaatagaattaacaacatgacggcagatgatatggatgatgccgttctaccatctgtttacgatggcaaccaagatcatatccgcttagtcgtgaaagacgtgctagataattggcagaaacgttctaacaattatgcttacaacgcgctatttactacccacgttggcggtcaacaatcatcaattaaaaatgctgtgagtttttacgaagagttcaagcgacagaatgctaaacgaaagcgtccattacgaattggcattacttttagcatggacacaacgaatagtagtacccagcaaggaactaatgacggtttacttgaagcgattaatgattataatgctgcttttggcgagcgctttgatctaacaaacgtaagagggtactcagaggctgttgtgacacgtttaaataaaacggtagatgataaacgttactttgatttggtcattgtcgttgatcagcttctaactgggtttaacgccccagaactaaattgtctatatgtcgatcgtactctcaaaggggcgaatctgatccaagcttattcccggactaaccgcgtgcagaattttcagacaaaaccgtttggccggatcgtgaactaccgctggccaaatcagtcagaaaagttgatgaaggaagctattcaggtatatgccaatcgtgattctgcaaacgtgcagctcacagtgggcccggatgatacatctggcgtgattgaaaaaagttacaacgatctcaaagatgaaatgaaaaagattgtcaaagaggcggccagtttaactggaaactttacaatgacaccgccgagtgaaagcgcccaagagcatttatataatctgctgcatgattacaatctcaccatggcaaaacttaagcaggatgacaaatatgacattgatcaccctgaaacacttttaagtcaaattggactgacacccgatcaagaaattcaactgacaactgttattgctggtgacttgaaagctaatattgccgaaaaacgaaatattgatatcagtgatctaacgctgcaaatggaacacgtgaaggatattcgcgttacgtatgattatatttccgaactgctggctgaacttgcaaataaagtgcatgacaatgatcaagaaggtagtactgccacgcgaacacaaattcaacaggctaccgagcagatggatgatgaacgctatgcaacaaacattcgtagcctagcagatgccttggtcaacggggaaaccaaggcggaacaatatccagtcaaagctaatgatgtgaagagcatgattaccaaccatattaaccagacaaagcggttgataattcgtgactttaagcaatggtggggtgtttctgatattccgtcagaccgcttgattaatcaaattgtggaagaacatacactcggcgaagatgatttaaatgccaccggagccttgaactcgattctcaaagagggtcaagcaacgtataagactgatgcaaaagatgaaaaagtgcgtcaattgtcgccgataaaatttagaaacaaattccgtcaagcctttgcagaatttgctgatcaatacaagaaacagttttag

SEQ ID NO: 122 - protein, 1029 aa, Lactobacillus rhamnosus
MGIERNELAFESKLIDHLQHIGGTKQWQYLPDIKDGEDLWQNFKVILERNNADQLQKPLSVAEFNQVQAKIRNLRSPYEAGQFLYGLNGTSQIEVDRDDGKHVFLTVFDQAEVGAGNTVYQIVNQIRRPPVQAGRPARRFDVTLLINGLPIIQIEEKADSHDPKEALNQMHQYIHERQYTDIFSTLQILVSMTPHDIRYMANTTDDMFNLDFAFRWQRESDNRPIRDWREFSNLMLSIPMAHQMATNYIILDGTKNRKMIKVMRPYQVYATIRVINKIRRQQFGLDPKEVGYIWHTTGSGKTISSFKAAWLASRLPNVDKVVFLVDRIALTNQTVDEYRAYDPDSDPDGKNGVVADTANKTVLKQKLKTKRSGIIVTSIQKLDGLARNNFKFDKNVVFIVDEAHRSTAGEMIQHIKAAFPKSAWVGYTGTPNFDATKGPTTYEIFGEVLHAYTIRDAIADHNVLGFKVDFETTLTDSALRESYLPKYFAWRYPEWPKEKIENRINNMTADDMDDAVLPSVYDGNQDHIRLVVKDVLDNWQKRSNNYAYNALFTTHVGGQQSSIKNAVSFYEEFKRQNAKRKRPLRIGITFSMDTTNSSTQQGTNDGLLEAINDYNAAFGERFDLTNVRGYSEAVVTRLNKTVDDKRYFDLVIVVDQLLTGFNAPELNCLYVDRTLKGANLIQAYSRTNRVQNFQTKPFGRIVNYRWPNQSEKLMKEAIQVYANRDSANVQLTVGPDDTSGVIEKSYNDLKDEMKKIVKEAASLTGNFTMTPPSESAQEHLYNLLHDYNLTMAKLKQDDKYDIDHPETLLSQIGLTPDQEIQLTTVIAGDLKANIAEKRNIDISDLTLQMEHVKDIRVTYDYISELLAELANKVHDNDQEGSTATRTQIQQATEQMDDERYATNIRSLADALVNGETKAEQYPVKANDVKSMITNHINQTKRLIIRDFKQWWGVSDIPSDRLINQIVEEHTLGEDDLNATGALNSILKEGQATYKTDAKDEKVRQLSPIKFRNKFRQAFAEFADQYKKQF

SEQ ID NO: 123 - DNA, 3168 bp, Lactobacillus rhamnosus
atgttggaactgtcgtttgaaaaagaagttgttaaaaccttaacgactggaagcaatcaatgggtggaacgaaaagacctatatggtgcgacgccggatcaattatgggctaattttcgtgataaattaaataacaataactatgctaaattgcagggataccctttaactgataccgaatttaatcaagttaaacgggcgattgaggtccggacaccttacgaagcagctaagttactagccgccgaaaatggcattggcaaagtggaagttgaacgtgatgatgctaagctgggcacggtgacgcttgagttgttttggaaagcggacgttgctggtggtaaatctagttatgaagtggtgcgacaagcagtgcgaccacggttagctggtactcaaaatgtcgatcctgatcgccgttttgacgtaaccctattaattaatgggttacccttaattcaattggaactaaaaaaagccacggtcgaacttaaccaggcttttaatcaaattgaaaaatacgcgcaggaaggtaaatatacggggatttactcgctgctgcaaatgtttgtgattatgacgccggatagtacggcgtattttgcgaatgccgaaccggatcatttcaataaagcctttttgttcaattggcgaacgcgggataatcaccccgtggaaaacggcttagcgtttacgcgccaagtccttaatattcccatggcccacaaaatggtcagtgaatatacggtcatcgaccaagaacgtcagagcttaattctcttacggccttatcagatttatgcgattgaagccgtgatgcaccggattcatgaccatcaagatggctttgtttggcataccacgggttctggtaaaacactcacctcatataaaaccgctaaattagcggcgcaagatcccggtgtcgataaggtcatcttcttagttgaccggcgggatttagacgaacagacaactagcaactttagtgcctatgcctccaatgatgatattgccattaacgaagcccaaaacaccggtgatttaatgcgtaaattgcaacaaaatgacggtaaggtcttggtcacctcgattcaaaagctccatcgggcggtcaaaaaaacgcaagcccagctggcaaccggtaagcaatcccgctttagtaaaactttaaagcaacgggtgatcttctttgttgacgaagcccaccggtcgcaatttggtaagatgcaaaaggaaattcggtcagcgtttatcaatagtaactggtatggttacaccggcactcccatttttaatgaaaataagaagcagctcaagggtgatctggcggttaccactgaggagctatttggtaaagtctgtcacgtctataacttgcgagacgctcttgaggaccaagccgtgttaccgtttaacgtggaacatgtaacgacgattggcaaagacacgttaataacccgggccctcgaaaaagaaacccagcgcgtcaaaacgcgtcgtgataggcaaggccgcctgctgagtatggctgatgaagcaaaaatccaagccaagattcaagcgatgtcagtgaaggacttggaagaaacgtatttaactccggctgactttgagactgatgaacatattaaccaagttgttcaatatgttttacaaaaaggtccgcgtaaaaccagcttgggtcatggcaactataatgctattttgaccactagttccattgaaatggcgcaacgctattatcaagcatttaaagccgctaaaaagactactcacaatcagctggatcctaattggccccgaattgcgattacttattcattaagtgaaaacgaagatcagagtgcgcacaaacatgatcaaatggccaccattttaaaagattataatcggcagtatcacactaattttgatttagccgatttgaatctctataacgaagatgtcgcaaaacgggctgcccggcgtgagtccgtctttgctcatttacaacctgatcaagaaataaatttagtgattgtggtgcggcggttattaacgggttttgatgcccctcggctaaacacgctctttgttgaccgcaccttagcttatcaagaactcattcaagcctactcacgcaccaaccggctccaaaaccgggaattaaaacaagagggtcaaattgtgacctttcgagtgccggcaatcatggaagctaatgaacgtgaagcttacaagttatatagtggcgaaggctcctttaatgtcatcattcggcccacttatcagcaggccgtcttaaaatttcaaaaggctgtggcggatttaaaagctattgcctcgacgccgacggcggccgatgacctgaaaggaaccactgccaaggtacagtttgtgaaagcctttcgccaagtgaatcaacaattgaactcgctatcgatgtacaacgatttcacttgggagaacagcgaaaaggcctttggtatcgctcagcccgaagtagaatcctatacgggtaaatatctgcggattaaagcggcggttactaaccaagagcctgagaaagtccccgaagaattggccgctttagacttttccttagccgttggttcagtcgtcttggtggattatgattatttgacgcaattaattcaagattggattgatgaacagcaacagtactcgacgcctgatcaagcccaagcgcatatgacggattatctgcaaaatagtgccaaagtacaggctagtttgaataaattagcggaaacgcaaccgcaacaggctcaattaattcgcgaagccatgccctatattgagcaacaaatgcaacagtttcagcaacagagcaccccaaatcaagtgccagtagcgttgaacgctcgggagttggtggctgattatgcccagagacaattggtcaaaaaaacgtcggtattcgcccacacgtggggcttagatcaagcagccctattgcgggtggcgcgtgaacacaccgtgggtaccgatgaatggcatcatgaacaagaattaacgcagtcagcgaatttagcagcggccttacaagctcaaactgccactgggccgaagattccagctattttgccactataccggattaagtcccaggccgcttggcggcagtttattgaacacgatttagcaatttatctacaaaaataa

SEQ ID NO: 124 - protein, 1055 aa, Lactobacillus rhamnosus
MLELSFEKEVVKTLTTGSNQWVERKDLYGATPDQLWANFRDKLNNNNYAKLQGYPLTDTEFNQVKRAIEVRTPYEAAKLLAAENGIGKVEVERDDAKLGTVTLELFWKADVAGGKSSYEVVRQAVRPRLAGTQNVDPDRRFDVTLLINGLPLIQLELKKATVELNQAFNQIEKYAQEGKYTGIYSLLQMFVIMTPDSTAYFANAEPDHFNKAFLFNWRTRDNHPVENGLAFTRQVLNIPMAHKMVSEYTVIDQERQSLILLRPYQIYAIEAVMHRIHDHQDGFVWHTTGSGKTLTSYKTAKLAAQDPGVDKVIFLVDRRDLDEQTTSNFSAYASNDDIAINEAQNTGDLMRKLQQNDGKVLVTSIQKLHRAVKKTQAQLATGKQSRFSKTLKQRVIFFVDEAHRSQFGKMQKEIRSAFINSNWYGYTGTPIFNENKKQLKGDLAVTTEELFGKVCHVYNLRDALEDQAVLPFNVEHVTTIGKDTLITRALEKETQRVKTRRDRQGRLLSMADEAKIQAKIQAMSVKDLEETYLTPADFETDEHINQVVQYVLQKGPRKTSLGHGNYNAILTTSSIEMAQRYYQAFKAAKKTTHNQLDPNWPRIAITYSLSENEDQSAHKHDQMATILKDYNRQYHTNFDLADLNLYNEDVAKRAARRESVFAHLQPDQEINLVIVVRRLLTGFDAPRLNTLFVDRTLAYQELIQAYSRTNRLQNRELKQEGQIVTFRVPAIMEANEREAYKLYSGEGSFNVIIRPTYQQAVLKFQKAVADLKAIASTPTAADDLKGTTAKVQFVKAFRQVNQQLNSLSMYNDFTWENSEKAFGIAQPEVESYTGKYLRIKAAVTNQEPEKVPEELAALDFSLAVGSVVLVDYDYLTQLIQDWIDEQQQYSTPDQAQAHMTDYLQNSAKVQASLNKLAETQPQQAQLIREAMPYIEQQMQQFQQQSTPNQVPVALNARELVADYAQRQLVKKTSVFAHTWGLDQAALLRVAREHTVGTDEWHHEQELTQSANLAAALQAQTATGPKIPAILPLYRIKSQAAWRQFIEHDLAIYLQK

SEQ ID NO: 125 - DNA, 3216 bp, Lactobacillus salivarius
atggatgaattaaaattcgaaagtgaattgattcaatatattacacatgggacaattactcattcgagaaatgatgttaattcttgcgaacaacttgatgatcctgatgtgtcgaactacattacaaaatcaaaattgtggaaatacgagccatcaattagaacaacagatgagctttggaataactttaaggcaattttggagcaacataatcaaagtacgttggatcgtcctttgtcagttgttgagttcaatcaggtaaaaaagattatttctgatttaaagacaccttatcaagcaggacaatttctatatggtttaaatggggtttcgcagattgaaattgatcttgatgatgggcgccacgtattcttgacagtatttgaccaaaagaaagttggtgccggagatactgtttaccaagttgttaatcaaattagacgcccagctgtgattacaggtcgacctgatcgacgttttgatacaactttacttattaatggtttaccaattattcaaattgaagaaaaacgtgatacgcatgatgtgaatgaagcattaaatcaaatgcatcaatacataacagagaatcaatatcacgatatttattcaactttacagattttggttgctattacgcctaataacgttaagtatatggctaatacaactgctgataagtttaacaaagattttgctttcaattggcaacgaagagatgataacagcatcgttaggaactggaaagaattcgctgattctatgctttctatccctatggctcatcaaatggcaactaactacatgatcttggatggaacaaagaataagcaaatgcttaaagtaatgcgtccttaccaagtttatgcaacacaaagagtaattgaaaagcttaaaaaagttgattttgattctggtaaaaataaagttggctatatttggcacacaacagggtctggtaagaccattactagttttaaaacagcatggttagctagtcgaatgcctaaaattgataaagtagttttcgtggttgaccgaatcgctttgacaaggcaaacatttgaaaactataaggcctacgatcctgatgctagtgatgaatcactcggaagtgttcaagatacgaagagaacaactgaacttagtcgtcgtttacgcagtaatgatgatggaattattgtaacttctgttcagaaattaaacacacttattaataagaaatctttcaaagatcctggtaaaaatatcgtctttattgtcgacgaagcacatcgttcaactggtggagcttcattcgctgatattcaaaaagcatttaaacatgctgcttgggttggttatagtggtacgccaatgtttgatgaaacaacatcaggattacgaacagaagatatatttggacctttgttacatgcctacactattagagaagcaattgctgatcataatgttttaggatttaaggttgattttgaaacaacgattgatgaagaaaagatgaaaaaagattacttaccatctttctattataaacattatcctgaatggacagatgaacagatagaagaaaagattgcaaatcttactccagaagatatggatgatgcagtagagcctagtttctatgatgaaaatccagaacatatccgcttagtagtggaagatattttcaagaattggcgtaatcgttctaatgatgggaagtacaatgccttgtttactactcacgttggtggtggaaaggcaagtactccaatggcaatgatgtactttaaagaatttcaaagggttaataaggaacatgctaaaactggcgacttaactttgaaagttgcagtaactttcagtcagagtactaataacggcgataatatggtcgcaactaataacaacttagaatatgcgatgaacgtctacaataaagaattcggtacaaacttcaagttagatacagttgctgaatacacacaagatgtaactagtcgtctaaataagagtgcacgtgataagaagttcttggatattgtaattgttgttgatcaacttctaacaggttttgacgctcctgaaatgaatactttatatgttgatcgtactttgaaaggtgctggcttaattcaagcatactctcgaactaatcgaattgctgatattcaagaaaaaccttggggacgtatcgtcaattatcgttggcctgctcaaaacgagaagttgatgaacgatgcgttggcaatctatgcaaataaggattctgcgagtctttcagatgaagaacgtaaagctaagaataaatctgacggtattactgcacctgaatttaaagacttattcaaagaagttaaagaaaaagttaacagattgtctaatttaactagcgaattcaatgaattacctaaatctgaaagagcaaaagatgaaatgtttgaactgttgcgtgaatataacgctggaattgctaaattaaagcaatatgatccacaagaaacaaaagatgaagatattggatttgattatgataatcctgatgctttgattgaacaattaggtatgactccagatcaggaaacaatgttgacaacagtattaactaatgaactaaaacaacatattgctaagaaaaaaagggtaccactttatcaaatagagttgaaattaactcatattaaagacgttaaggtgaattacgattacttaacagaattagtagaacaattattgaatcaagtgcatgaaggtaaggctgaagaagctaaagatacacaaagtaaaattgaaaaatttgctaatggacttgatgatgctaactacgccaagaagattaaggctgctgctttggcaattattgaaggtcattatccaccaaaaggatccaactttaagtatccagcaaaacttgatagtagtgacaaaataattcagggggctaatgcagttagtctagatagattattcttggatttccgaaatgattggggagctacagccgccttggcggccgcgggaattcgaattgagatgattagtcgccaccgttacgctcaacaagatcttgatgatactgggcaaattcgcgacatattggcaaaagctgcgactaactataagcagctagcctataaggaagaaattcaaaaactatctaaaatcaagtatcgcaatggtttacgcgaagctatctacaagttagcaggtaatatgcttgatagaatttaa

SEQ ID NO: 126 - protein, 1071 aa, Lactobacillus salivarius
MDELKFESELIQYITHGTITHSRNDVNSCEQLDDPDVSNYITKSKLWKYEPSIRTTDELWNNFKAILEQHNQSTLDRPLSVVEFNQVKKIISDLKTPYQAGQFLYGLNGVSQIEIDLDDGRHVFLTVFDQKKVGAGDTVYQVVNQIRRPAVITGRPDRRFDTTLLINGLPIIQIEEKRDTHDVNEALNQMHQYITENQYHDIYSTLQILVAITPNNVKYMANTTADKFNKDFAFNWQRRDDNSIVRNWKEFADSMLSIPMAHQMATNYMILDGTKNKQMLKVMRPYQVYATQRVIEKLKKVDFDSGKNKVGYIWHTTGSGKTITSFKTAWLASRMPKIDKVVFVVDRIALTRQTFENYKAYDPDASDESLGSVQDTKRTTELSRRLRSNDDGIIVTSVQKLNTLINKKSFKDPGKNIVFIVDEAHRSTGGASFADIQKAFKHAAWVGYSGTPMFDETTSGLRTEDIFGPLLHAYTIREAIADHNVLGFKVDFETTIDEEKMKKDYLPSFYYKHYPEWTDEQIEEKIANLTPEDMDDAVEPSFYDENPEHIRLVVEDIFKNWRNRSNDGKYNALFTTHVGGGKASTPMAMMYFKEFQRVNKEHAKTGDLTLKVAVTFSQSTNNGDNMVATNNNLEYAMNVYNKEFGTNFKLDTVAEYTQDVTSRLNKSARDKKFLDIVIVVDQLLTGFDAPEMNTLYVDRTLKGAGLIQAYSRTNRIADIQEKPWGRIVNYRWPAQNEKLMNDALAIYANKDSASLSDEERKAKNKSDGITAPEFKDLFKEVKEKVNRLSNLTSEFNELPKSERAKDEMFELLREYNAGIAKLKQYDPQETKDEDIGFDYDNPDALIEQLGMTPDQETMLTTVLTNELKQHIAKKKRVPLYQIELKLTHIKDVKVNYDYLTELVEQLLNQVHEGKAEEAKDTQSKIEKFANGLDDANYAKKIKAAALAIIEGHYPPKGSNFKYPAKLDSSDKIIQGANAVSLDRLFLDFRNDWGATAALAAAGIRIEMISRHRYAQQDLDDTGQIRDILAKAATNYKQLAYKEEIQKLSKIKYRNGLREAIYKLAGNMLDRI

SEQ ID NO: 127 - DNA, 3126 bp, Lactobacillus salivarius
atgccaaaaggttatctaacagaagaatcagtagaagatttagcattagatgaactagaaaaattagggtattcagtatttaaaagtgaaagttatacatcgcctaataagcaaatagatgcagctaggaataaagatcatacagttgctattttattaactaacttagacaaagctttgcgtagacttaatccaggatatgaagatgaaatatacaaagaagcagtacgtaattttattagattagctgataaccctaatatgatgattaataatcattatcttcataagttattggttgaaggaataagaatcaaaacaagcgtaaatggggaaagtcgtacagtgactttatatgcaattgattttgataatgtagataataatgaatttattgctactaatcagtttacatttgagggacgacatgagcgtagaccagatgtaactctatttattaatggattaccacttgttacttttgagtttaaggatattttaaaccctaatgtaagtattcgtgatgcttataatcaatttgaaacatacaaagaagaaatttcagattatatgaaatataacgagattctgattatttctgacggtataaatactagagctggttcaataacagctggttttgatcgtttcatgagatggagagcacctaaaaatataacagatactacagaattagaattagttacattaatcaaatatatgctcgagccaagtgttttattggatttaattgaaaactttattatttttgaaactaatggagattctacgattaaaatattaggtgcctatcatcagtactacatggtaaataaggcaataaaagctgctagaaaagcaattaaaaattcagaagataagcgtataggagtagtatggcataccactggttctggtaagagtttatcaatggtattttttgcaagtatagctgctcgtaaattgaataatccaactatgttggtaattaatgatcgtaatgatttagatgatcagttgtttgatactttttcagcagcacatgaatttctacgacaaacaccagagcacgttgaaactagagatgatttgagaaatgcaatggacaaaaattcaggtgggattgtattttctacgattcataaattctatccagagtttgaaaaaggtgaaaaagaaatgccagtgctatctgaaagaagtgacattattgttattgctgacgaagcacaccgtactcaatatgggttaacagctaaacaaactaaaaatggtattagatatggttatgctaagtatttgcgcgatgctttacctaatgcttctttcattggctttacaggaacaccaatttcaacagaagacaaatctacaattaatgtctttggtaattatattgatatctatgacattactcaggctgtagatgatgatgctactgttagaatttactacgaaagtaatgttttcccactaaaactaaaagagggaacagaagaagagtatcaaaagttaattaaggaagctaatttagatgatgatcctaatttggaagaaaataaacgccgaaatcgtgaattttcaagattagaaacattagctggagcaaaatcaagattacaaagcattgctaagcattttgtcaatcattttgaaaaaagacaaaaagaaacatttggtaaatcgatgattgttgaaatgtcgagaagaaatgctgttaatttatataatgagattattaaattgcgtccagattgggcaagtgatgatttagaaaaaggcaagattaagattgtaatgacatcttcagcagctgatggaccagaattggctaaacatcagacaagcaaagctgatcgtagaattctacaaaaaagaatgaaagataacaatgatgaacttcaaattgtaatcgttgttgatatgtggttaacaggatttgacgtgccatctatgaatacaatgtatattgataagccgatgaaaggccataatttaatccaagcaatcgcacgtgtaaatcgagtatttaaagataaagacagtggtttaattgtagactatattggaattgctgaaagcttaaaatcagctttgaatatatattcaaagaaagatcaaagtcaagttggtatcaacatgaaaaaagctatagcagttttaaaggaaaaatatgatattattacgaatgatttcttgtatggtatagattactcagattttaagtcagaaaaaagtagtgtacgaattagcattactaatcgtgtagctaatgaaattcttagacaaaaagatgatagctggagaaaatttatagatgtagttactgaattgcaaaaagtatatgctataactgctactcaggaagaagctcaagtatatggagaagagattgcatttttcaagtctgtaaaatccttaatagttaagttaaagagaaagccgattacaggtggaggaaatggtaaagatcctaaagaagttgattatagacttaagcaatttatagatcaatctgttatttctgaaaaagacgttgatatttataaacaatttggaataaataaagaaagtattgaattaatttcggatgaattcttggatgctatgaagaaagagcctgaaaaagatctagcaattgttgtactggaaaatgttttaaagggtaaagtaaaagcaatgttgaaagttaatcaaactgcatccaaacaatttactgaaatgttaaagaaatccattgatgactacaataatcgcggtataacaagtgaactagttattcgtcaacttatagaaattgcaaagcaaatcagagaacaacaaaataaaggtgaagatcttggattaactcaagaagaagtagctttttatgatgctctagctgaccataagaaagcagtggaaatgttaggtgaagaaacactacaacttattgctaaagaattagtaaaagtcgtgcaaagagaagctggaatagattgggaaaaacgagaaagtgtccaagctaagatgcgaagagaagtacgaagattacttagaaaatatggctatccacctgattttcaaaagcaggcagtagaaactgtaatagagcaagcagaattaatggcttcaaataatagttag

SEQ ID NO: 128 - protein, 1041 aa, Lactobacillus salivarius
MPKGYLTEESVEDLALDELEKLGYSVFKSESYTSPNKQIDAARNKDHTVAILLTNLDKALRRLNPGYEDEIYKEAVRNFIRLADNPNMMINNHYLHKLLVEGIRIKTSVNGESRTVTLYAIDFDNVDNNEFIATNQFTFEGRHERRPDVTLFINGLPLVTFEFKDILNPNVSIRDAYNQFETYKEEISDYMKYNEILIISDGINTRAGSITAGFDRFMRWRAPKNITDTTELELVTLIKYMLEPSVLLDLIENFIIFETNGDSTIKILGAYHQYYMVNKAIKAARKAIKNSEDKRIGVVWHTTGSGKSLSMVFFASIAARKLNNPTMLVINDRNDLDDQLFDTFSAAHEFLRQTPEHVETRDDLRNAMDKNSGGIVFSTIHKFYPEFEKGEKEMPVLSERSDIIVIADEAHRTQYGLTAKQTKNGIRYGYAKYLRDALPNASFIGFTGTPISTEDKSTINVFGNYIDIYDITQAVDDDATVRIYYESNVFPLKLKEGTEEEYQKLIKEANLDDDPNLEENKRRNREFSRLETLAGAKSRLQSIAKHFVNHFEKRQKETFGKSMIVEMSRRNAVNLYNEIIKLRPDWASDDLEKGKIKIVMTSSAADGPELAKHQTSKADRRILQKRMKDNNDELQIVIVVDMWLTGFDVPSMNTMYIDKPMKGHNLIQAIARVNRVFKDKDSGLIVDYIGIAESLKSALNIYSKKDQSQVGINMKKAIAVLKEKYDIITNDFLYGIDYSDFKSEKSSVRISITNRVANEILRQKDDSWRKFIDVVTELQKVYAITATQEEAQVYGEEIAFFKSVKSLIVKLKRKPITGGGNGKDPKEVDYRLKQFIDQSVISEKDVDIYKQFGINKESIELISDEFLDAMKKEPEKDLAIVVLENVLKGKVKAMLKVNQTASKQFTEMLKKSIDDYNNRGITSELVIRQLIEIAKQIREQQNKGEDLGLTQEEVAFYDALADHKKAVEMLGEETLQLIAKELVKVVQREAGIDWEKRESVQAKMRREVRRLLRKYGYPPDFQKQAVETVIEQAELMASNNS

SEQ ID NO: 129 - DNA, 3006 bp, Lactobacillus salivarius
atgcgcggccaaattgacgaaaggtatgaataccaacgagaaattattgatcatttagttaatgagaatggttatgttgaacgaagtcatcgcaattttgataaaaattatgctctagatcgagaattgctgtttgagtttttaaaagatactcaacctgatattttagaagaattatcaaaaatttttggtgatgatttagaagaaaccattattaatacaattaataactttgtggttagtaaaaagggaagtttattaagtgttttgaaacatggtgttgatatcaataataaacctctaacgcttttatatggtaaacctgcaactagctttaatccggaactatctaggttatacaatgaaaatattttttctgtgatggaggaagtttatccagatgaagctaataaagaacgcattgatttagtaatttttgttaatggctttgcgattatcagttttgagctcaaaagtaacagtcaaggccaaaattatgaggatgcaattctccaatatcggacaagacgtaatcctaaagatcgccttttccgttttaaagctggatgcttagttaattttgccatggatactgaagaagtttatatgacaacacaactagataaagaaaaaactttcttcttgccttttaacatgggaaaaggagaaggagtaaatgctggtgctggtaatcctagttttgaagataaatatagtgtttcttatatgtgggaagatattcttaaaaaagatactttaattgaattgattaccaaatttatatttattgaatcaaaggaagataaggatcaagttactggtaaaaccaaaattaaggaaagagttatttttcctcgctatcatcagctagatgtaattcgtaaaactttggatgatttaaaggttaacaaaactagtcaaaattatctaattcaacattcagctggttcaggtaaaactaattcaattgcttggctagcacatcgtttagcgagtttgcatgatgaagatgatcaagttatttttgataatgtaattatcatgactgatcgagtagtagttgacagacagctacaaaaagcaattatgggtctagaacataaagttggtttaattagagttatggatgacaaatgtacttcagctgacttgaaattagcattagaaagtaatacaaaaattgtagttactactattcagaagttcccatatgttgttgatctgattaaagatggaagtaatcaaactggagtagtattaaagaataaaaaatttgcagtcattattgacgaagctcattcttcaactgctggtaaggatatgatggctgtaacaagtgcactatcttctacggatgacttctatgaacaagatgttcaagatcaactagttcaagaaattcaaagttcaggtaagcaaaaaaatgttagcatgtttgcttttacagcaacaccaaaaccgacaacacttcgtttatttggtcgtcctgataaacgtggtaattatcgtgctttccacctttatagtatgaagcaagcgattgaagaagggtttattttagatgttttagctaattacacaacttatgaaacgtattatgaattaaataagaaaattgatgatgatccagaattgaaaacaactgaagctaagcgacaaatagctcaacaaattgatctggatgatactaacattgctcaacgaactaagattattattgaacattttcgtcagcatgttatgtctgaattaggtaataaggctaaagcaatggtaattatgacatctagaaaagcagctgtgaagtatcaacaagctttccagaagtatattgaagaacatcattatactgatatgggattattagttgctttttctggaaaagtaaatcttgatgatgaaaatgaatttacagaagcttcaatcaatggtattagcgaagatagaacagcacgtgaatttaataaggaagcctatcgtttcttattagtagctaacaagtatcaagttggctttgatcaaccaaaattgacggcaatgtatgtgatgaaaaagattgctggtgtaaatgccgtacaaactttgtcacgccttaatcgtatttgcccaccatatgaaaagacgccatttgtgttagattttgctaatagttatgcagatattgaaaaagcatttgcgccatactacactacaactttgttagctgacacagttaataagcaattagtttataatatagttgaaaaaattgaaggtttctatgtaattgatccaatgagtgtagaaggtgcaaacttagtcttacataaagcacgtattgaaagtagagataaaaagaaattgaatttctactttggtgcgactgaaaagaaaatcaaagaattagatgaagttactcaacgagaagtcattgtaactttgcgtcgctttgttcgctgttatgaattcttattgcaagtttctagtttagatgatgtagagttacaaaaaatgtataattatatttcttatttattgaaatatgttaacattagtcgaccagggcaaggttatgacttagcaggtaagattaaagcaagtaattttgctcaaaagcagacaggaagtcatacaaaagggactaaacgatctaatccagaggttaaactgcctatggctgatgagattgaacttggtgaagataagaaaaagaaattgtctgcaattattgaagagattaaccaagcaactggctcaaactttgataaagatattgcggttaagtcgatgctacagttacgtgatttaatgatgaagtcaggtgatttgcgtagcagtgctaagaataacagcgagcaagacttcgaactttcttacttcgatcgaattgatgatatgttgattgaaggactggaacataacaaggaattctttactttgttactgaataataatgatttgaagaaagaggttcttggaacgtttgcttcagagatttatgattcgttgagaacaagtaaggaataa

SEQ ID NO: 130 - protein, 1001 aa, Lactobacillus salivarius
MRGQIDERYEYQREIIDHLVNENGYVERSHRNFDKNYALDRELLFEFLKDTQPDILEELSKIFGDDLEETIINTINNFVVSKKGSLLSVLKHGVDINNKPLTLLYGKPATSFNPELSRLYNENIFSVMEEVYPDEANKERIDLVIFVNGFAIISFELKSNSQGQNYEDAILQYRTRRNPKDRLFRFKAGCLVNFAMDTEEVYMTTQLDKEKTFFLPFNMGKGEGVNAGAGNPSFEDKYSVSYMWEDILKKDTLIELITKFIFIESKEDKDQVTGKTKIKERVIFPRYHQLDVIRKTLDDLKVNKTSQNYLIQHSAGSGKTNSIAWLAHRLASLHDEDDQVIFDNVIIMTDRVVVDRQLQKAIMGLEHKVGLIRVMDDKCTSADLKLALESNTKIVVTTIQKFPYVVDLIKDGSNQTGVVLKNKKFAVIIDEAHSSTAGKDMMAVTSALSSTDDFYEQDVQDQLVQEIQSSGKQKNVSMFAFTATPKPTTLRLFGRPDKRGNYRAFHLYSMKQAIEEGFILDVLANYTTYETYYELNKKIDDDPELKTTEAKRQIAQQIDLDDTNIAQRTKIIIEHFRQHVMSELGNKAKAMVIMTSRKAAVKYQQAFQKYIEEHHYTDMGLLVAFSGKVNLDDENEFTEASINGISEDRTAREFNKEAYRFLLVANKYQVGFDQPKLTAMYVMKKIAGVNAVQTLSRLNRICPPYEKTPFVLDFANSYADIEKAFAPYYTTTLLADTVNKQLVYNIVEKIEGFYVIDPMSVEGANLVLHKARIESRDKKKLNFYFGATEKKIKELDEVTQREVIVTLRRFVRCYEFLLQVSSLDDVELQKMYNYISYLLKYVNISRPGQGYDLAGKIKASNFAQKQTGSHTKGTKRSNPEVKLPMADEIELGEDKKKKLSAIIEEINQATGSNFDKDIAVKSMLQLRDLMMKSGDLRSSAKNNSEQDFELSYFDRIDDMLIEGLEHNKEFFTLLLNNNDLKKEVLGTFASEIYDSLRTSKE

SEQ ID NO: 131 - DNA, 3018 bp, Lactobacillus salivarius
ttggatttggagagagatattgaagaaaaattgatcaaccgcttaactcaaggtgtcagtcagtggacaagaagagatgatataaaaactgttagtcaattatgggataacttttttaagatactttctaaaaataataaagctcagttacatgatcacccattaactgaaaatgaaaaaaatacaattcgtacacagattacaaaacctaatttttatcaagcagctaagtttatggtaggggcaaatcgtcaagttaaattccatttaaaacgtgaagattcgactttacctgatgctgacttgactattttagataatacaaatatagctggtggaatttctgtttatgaagttgttcatcagattcaattagcaagaaagtttgaattagatcaagatcgacgttcagatataactttgctaattaatggtttgccaatgatacatattgaattaaagaaacctagtgaatcaattattaaggcctttaatcaaattcaaaagtatattaatgaagcaaaatttacagatattttttgcttcataaaaatgtttgttgtaagtaataagacaattacacgatacatttctgcagggcaaagtttgcgtgaaaaatttttaactgcttgggtagatgataagaatcaacgtgttgataattatctagattttgctagagaagtcttgtcgataccacaagcacatcatatgttagctgattacacagtgttagataatcaagccaaaaatattattctattgcgtccttatcagattcatgctatcaaagctatttttaaggcttcacgtgaacaaaaatctggttatatttggcatacaacaggttcgggtaagaccttaacttcatataaggtagctagaaatttactgcaaataccttccatacaaaaaacggtattcttgattgaccgccaagacttggatgtacagacagtaagtgcatttgaagcttatgcttataatgacacgattaatgttgatgatactgacaatagctatgatttggctaaccaattaattgataatgagaaaaaagttattgttacaactagacaaaagttacaagcaattttcagaagaattgatgaacaaaaagataacttatcaaagaaatatttaaaactgaaagatgtaaaactagcttttgtagtagatgaatgtcatcgtgcagttacaccgtcacaaaagagagaattggataagttctttaataaatcacctttgtggtatggatttacaggaactccaattatggataaaaatgcgcgtgctgaaaatggcaatgatgctagaactacaaaagaactttatggagatctattacacacttatacgattaaaaatgcgatagcagataatgcggtgttaggattccaaattactaatattggtcaagaaaacgttgaagatgaagaaaatactgaaaaatgggataagctttaccttaaggatgtacatatgaaggctgttgttaagaagattttaaatttagcttatgttaagcaaggactaaaagatggtaatcgatacgctgctatttttacaacttcatcaattaaacaagctcaaaaatattatcacatatttagagacatcgctaatggcgaaagtgagataaaagttcctaaggtaattaaagaaaaagcagtagattttccaagagtagcgataacttattcaatttcgcaaaatgagaatgattcaaaggataaccaagatgacatgaaagtttcacttaaagattacaatgcaatgtttgggactaactttgagatggggcaaattgatgcttataaccgaaatgttaacgatagacttgcacgaaagtctaagcagtatcaagctccaagccagcaattagacattgttattgtagttgatagacttttgacaggttttgattcaccaacgttatcaacgttatatattgatagacgaccaatgaatccacaaaatatgattcaagctttttcacgtactaatcgaatttacgataatactaagcaatggggacagattgttactttccaatatccagaaacttataaaaagaaaattgatgaagctattcaactttattcaaacggagctgccacatctgatataactgcgccagtttggacagaatctcggaagaaatatattgcagcacgaaatggaataaatcaatatttactagacaaaaaagcattagacagaatagttgatgcaccaattgaagaaatgaaagcttttgctaaagattttcaaaaattcgacaaggcatttatggcaattcaaacttatgatgaatattacaatcaagatgaattaccagaaaaagaaagaatatctataccagcattaactgatgaagaattagagcatctacagggtgtttattctaatgttattgaaaagataaaaaaacgtgryrgtawrrwrcgtgacagagatgaacctgatccggaatttgactgggaatatgaattaacccccatctacaataataagatagatgaacgctatattactaatctaattcaaaatgtggtatctgatactaacgaaagtgaactattccttaatgaaaaagatgtcgaagaaatcgatgaaactatcgataatttagaaaagataaacaaaccaaaagcagatataatcagaagtttatgggataaagttaagcaaaatccgcaagaatatgctggaacttcgattagtcaattagtagaagatttgattaacaaggaaaaccatcgtttgatgcaagaatttgcggataaatacaaagtggattataacgatctacgttatgtaattaacaactatgtttctgatggggacagtactcgtcaaaaaggtatggcagaaatgattgataaggaagcttacgagaaatttagggatgcatatccaaatgcagagtcattgttaaagtggaaacatagaatgcgtcaagaagtagatactttctacacagacaaaataagaccactaatgtatacagaataa

SEQ ID NO: 132 - protein, 1005 aa, Lactobacillus salivarius
MDLERDIEEKLINRLTQGVSQWTRRDDIKTVSQLWDNFFKILSKNNKAQLHDHPLTENEKNTIRTQITKPNFYQAAKFMVGANRQVKFHLKREDSTLPDADLTILDNTNIAGGISVYEVVHQIQLARKFELDQDRRSDITLLINGLPMIHIELKKPSESIIKAFNQIQKYINEAKFTDIFCFIKMFVVSNKTITRYISAGQSLREKFLTAWVDDKNQRVDNYLDFAREVLSIPQAHHMLADYTVLDNQAKNIILLRPYQIHAIKAIFKASREQKSGYIWHTTGSGKTLTSYKVARNLLQIPSIQKTVFLIDRQDLDVQTVSAFEAYAYNDTINVDDTDNSYDLANQLIDNEKKVIVTTRQKLQAIFRRIDEQKDNLSKKYLKLKDVKLAFVVDECHRAVTPSQKRELDKFFNKSPLWYGFTGTPIMDKNARAENGNDARTTKELYGDLLHTYTIKNAIADNAVLGFQITNIGQENVEDEENTEKWDKLYLKDVHMKAVVKKILNLAYVKQGLKDGNRYAAIFTTSSIKQAQKYYHIFRDIANGESEIKVPKVIKEKAVDFPRVAITYSISQNENDSKDNQDDMKVSLKDYNAMFGTNFEMGQIDAYNRNVNDRLARKSKQYQAPSQQLDIVIVVDRLLTGFDSPTLSTLYIDRRPMNPQNMIQAFSRTNRIYDNTKQWGQIVTFQYPETYKKKIDEAIQLYSNGAATSDITAPVWTESRKKYIAARNGINQYLLDKKALDRIVDAPIEEMKAFAKDFQKFDKAFMAIQTYDEYYNQDELPEKERISIPALTDEELEHLQGVYSNVIEKIKKRDGKERDRDEPDPEFDWEYELTPIYNNKIDERYITNLIQNVVSDTNESELFLNEKDVEEIDETIDNLEKINKPKADIIRSLWDKVKQNPQEYAGTSISQLVEDLINKENHRLMQEFADKYKVDYNDLRYVINNYVSDGDSTRQKGMAEMIDKEAYEKFRDAYPNAESLLKWKHRMRQEVDTFYTDKIRPLMYTE

SEQ ID NO: 133 - DNA, 3165 bp, Lactobacillus sakei
atgagtgtaagttcgtttactttagaaaacgatgttgagcaacaagccattgattggttagttgctcaaggttatcaagatctgcgtgctaccagtaatggcggacgtaatgaacagatttatttagagcgtggaagtgatgaacacaacattttgttgaccggtcgtttacgtttggcttttgaacgcttgaatccaggatatacggatgacgattatagtgaggctgtgcgccagatgcagcgtcttgcagatagccctgacatgatgattgataatcataagatgcacaagttcttaattgaaggcgttaagattcaacgttctgttaatggtgaaaatcgaacattgactttgcgaccaatcgatttcaagaacgttgaatctaatgattttgtagtgacaaaccaggttactgttttgcaaggggatcacaaccgtcgtccggatattgtgttatatatcaatggactaccgttggtgacgtttgaacttaagaacctgtcgaatgtagatgcaggtatttcaaatgcttacaaccagttccagacgtacaaacgtgaaatttccaatttcatgcgttataacgaaatattggttactgctgatatggttcaggcacgagctggttctctaacagctgatgagtcgagattcatgcaatggcggttacctgaggaagtgaacggtagttctaaaccgctatttcagctagaaagccttattcgaggaatgatgaacccaataactttgttgaatttgattcagaactttatcatatttgaaacagatggcgataagacaatcaagattcttgccgcgtatcatcagtactatatggttaacaaggcagtgacatctgctaagcgtactgttgagaccccgggtgacaatcaaattggtgttgtttggcacacgcaaggatcgggaaaatcgttgtcgatggtctttttctctggaattgtcggtcgtgaactcggcaatcccacgatagttgtcatcaatgatcgtaacgatttggataatcaactgtcaggcacgttcgcagctgcaagtgaattcttgggtcaggagcctaagcaggccgattcacgtgaagacatgcgtcgtctattgagtgtaaattctggtggtattgtgttcacgaccatgcaaaaattctcacctgagtttgaaaatggcgagaccgacatgccagttttaacagcccgtgacaatgtgattgtgatggccgatgaggcacatcgaacacagtacggcttaggggcaaagtattctaaggatggtgaaactaagtatggttacgctaagtaccttcgcgatgctttgccaaacgcctcgtacattggttttactggtacgccaatcgatatgtctgataagtctactaaggccgtatttggtgattatattgatgtttatgatatgacccgagcggtagaagaccatgcaacagttaaaatttattatgaaagtcacgttatcccactagattgggataaagcggaattgaccgaagaagtcatcgagttcctggataatgatttagatgaaaatccagatacggcaaagtatgcacgccttgaagcactagctggatctgcacctcgagtgaagaagttagctgaacattttgtagaacactttgagacacgtcaaaaggctgaagatggtaaaagtatgattgtagctatgtcccgtcgaaacgcagttgctatctacgatgccattgtgaaactgcgtccggagtggcattctgatgatttggataagggtaagataaaaattatatttacagctaatgcctctgatgatgagtatctaacgaagcaccacacgaacaagaaggaacgtgaacacttgcaacgtcgtatgaagaatgatgctgacgagttgaaaattgttattgttgttgatatgtggctgacaggatttgatgcgccttcaactaatactatgtacatcgacaagccaatgaaaggacacaatttgatgcaggcaatcgcccgcgttaatcgtgtttttaaggacaaagattcaggcctagttgtggattatattgggatcgctgacaatttgaaatcagcgttacaacagtattcaccatccgaccaagagcaagctgggattaacatcgaaaaggctattagtgtgatgcaagaaaaatataacatcattacacgtgattatttatatggcgttgattattcaaactttaattccagtgatcgttctttgaaacttgaaacatttcgaaatgtgctgaacgatttactttcaccagaagaattttctgtaaacgcaactccatataacaatgctgaacctattgatccagacaagttaactgaacgtcaaaccgcattccgtgatacagtaacgcaattacaacgtgcgtttgctctagtcgctacgacatctgaagctcagactatttctgaagaattagccttctttgttgcattgaagaatgccatgattaaaatgattgtcactagtgaaggcggtgtcgagaagtctattgactatcgtatgcgtcagctgctagataggtctattattcctggtgaagttgttgatttatacaaggatctgggattgaatcgtccagaactagacttgctgtctgatgagttcttggacgaagttcagaatatgccgcaaaagaatgtggcattggacttgttggaacgattactaaagggacaagttaaagcattgacttgtacaaatttagttaaagctaagaagtttgatgagatgttggcagcttcaattgagttgtacaacgcccgtggattgactaccgaaattgtgattcgacaattaattgacatagctaaggatattaataaggcgcagaaggaaggtgaaaaactcggcttgtcacctgaagaagttgctttttatgatgcattagccgatcacgataaggctcgtgaagaaatgggtgaagaaaagttgcatcaattggcagccaagttggtcgaagaagtgcgtaagaatactggaactgattgggtacgacgtgattcaacacgtgcgcaaatgcgggtggctgttaagaaactgctacgtcaatttggatatccgcctgattttgcagcagaagcgattgatactgttgtgacacaggcagaaaagatggccttaaacgagtcgtga

SEQ ID NO: 134 - protein, 1054 aa, Lactobacillus sakei
MSVSSFTLENDVEQQAIDWLVAQGYQDLRATSNGGRNEQIYLERGSDEHNILLTGRLRLAFERLNPGYTDDDYSEAVRQMQRLADSPDMMIDNHKMHKFLIEGVKIQRSVNGENRTLTLRPIDFKNVESNDFVVTNQVTVLQGDHNRRPDIVLYINGLPLVTFELKNLSNVDAGISNAYNQFQTYKREISNFMRYNEILVTADMVQARAGSLTADESRFMQWRLPEEVNGSSKPLFQLESLIRGMMNPITLLNLIQNFIIFETDGDKTIKILAAYHQYYMVNKAVTSAKRTVETPGDNQIGVVWHTQGSGKSLSMVFFSGIVGRELGNPTIVVINDRNDLDNQLSGTFAAASEFLGQEPKQADSREDMRRLLSVNSGGIVFTTMQKFSPEFENGETDMPVLTARDNVIVMADEAHRTQYGLGAKYSKDGETKYGYAKYLRDALPNASYIGFTGTPIDMSDKSTKAVFGDYIDVYDMTRAVEDHATVKIYYESHVIPLDWDKAELTEEVIEFLDNDLDENPDTAKYARLEALAGSAPRVKKLAEHFVEHFETRQKAEDGKSMIVAMSRRNAVAIYDAIVKLRPEWHSDDLDKGKIKIIFTANASDDEYLTKHHTNKKEREHLQRRMKNDADELKIVIVVDMWLTGFDAPSTNTMYIDKPMKGHNLMQAIARVNRVFKDKDSGLVVDYIGIADNLKSALQQYSPSDQEQAGINIEKAISVMQEKYNIITRDYLYGVDYSNFNSSDRSLKLETFRNVLNDLLSPEEFSVNATPYNNAEPIDPDKLTERQTAFRDTVTQLQRAFALVATTSEAQTISEELAFFVALKNAMIKMIVTSEGGVEKSIDYRMRQLLDRSIIPGEVVDLYKDLGLNRPELDLLSDEFLDEVQNMPQKNVALDLLERLLKGQVKALTCTNLVKAKKFDEMLAASIELYNARGLTTEIVIRQLIDIAKDINKAQKEGEKLGLSPEEVAFYDALADHDKAREEMGEEKLHQLAAKLVEEVRKNTGTDWVRRDSTRAQMRVAVKKLLRQFGYPPDFAAEAIDTVVTQAEKMALNES

SEQ ID NO: 135 - DNA, 3015 bp, Lactobacillus salivarius
ttggatttggagagagatattgaagaaaaattgatcaatcgcttaactcaaggagttagtcagtggacaagaagagatgatataaaaactgttagtcaattatgggataacttttttaagatactttctaaaaataataaagcccagttacatgatcaaccattaactgaaaatgaaaaaaatacaattcgtacacagattacaaaacctaatttttatcaagcagctaagtttatggtaggggcaaatcgtcaagttaaattccatttaaaacgtgaagattcgactttacctgatgctgacttgactattttagataatacaaatatagctggtggaacttctgtttacgaagttattcatcagattcaattagcaagaaagtttgaattagatcaagatcgacgttcagatgtaactttgttaattaatggtttgccaatgatacatattgaattaaagaaacctagtgaatcaattattaaggcctttaatcaaattcaaaaatatattaatgaagcaaaatttacagatattttttgtttcataaaaatgtttgttgtaagtaataagacaattacacgatatatttctgcagggcaaagtttgcgtgaaaaatttttaactgcttgggtagatgataagaatcaacgtgttgataattatctagattttgctagagaagtcttgtctataccacaagcacatcatatgttagctgattacacagtgttagataatcaagcaaaaaatattattctattgcgtccttatcagattcatgctatcaaagctatttttaaggcttcacgtgaacaaaaatctgggtatatttggcatacaacaggttcgggtaagaccttgacttcatataaggtagctagaaatttactacaaataccttccatacaaaaaacggtattcttgattgaccgtcaagacttggatgtacagacagtaagtgcatttgaagcttatgcttataatgacacaattaatgttgatgatactgacaatagctatgatttggctaaccaattaattgataacgagaaaaaagttattgttacaactagacaaaagttacaagcaatttttagaagaattgatgaacaaaaagataacttatcaaagaaatatttaaaactgaaagatgtaaaactagcttttgtagtagatgaatgtcatcgtgcagttacaccgtcacaaaagaaagaattagaaggatttttcaaaaactcattgtggtatggatttacaggaactccaattatggataaaaatgcacgtgccgaaaatggtaatgatgctagaactacaaaaggactatatggagatctattgcacacttatacgattaaaaatgcgatagctgataatgcggtattaggattccaaatcactaacattggtcaagaaaacgttgaagatgaagaaaatactgaaaaatgggacaagctttatcttaaggatgtacatatgaaggctgttgttaagaagattttaaatttagcttatgttaagcaagggctaaaagatgggaatcgatacgctgctatttttacaacttcatcaattaaacaagcccaaaaatattatcacatatttagagacatcgctaatggtgaaagtgagataaaggttcctaaggtaattaaagaaaaagcagtagattttccaagagtagcgataacttattcaatttcgcaaaatgaaaaagattcagaagataaccaaaaagatatgaaagtttcgctcaaagattacaatgcaatgtttgggactaactttgagatggggcaaattgatgcttataaccgaaatgttaacgatagacttgcacgaaaatctaagcagtatcaagctccaagccaacaattagacattgttattgtagttgatagactcttgacaggttttgattcaccaacgctatcaacgttatatattgatagacgaccaatgaatccacaaaatatgattcaagctttttcacgtactaatcgaatttacgataatactaagcaatggggacagattgttactttccaatacccagaaacttataagaagaaaattgatgaagctattcaactttattcaaacggagctgccacatctgatataactgcgccagtttggacagaatctcggaagaaatatattgcagcacgaaatggaataaatcaatatttactagacaaaaaagcattagacagaatagttgatgcaccaatggaagaaatgaaagcttttgctagagatttccaaaaatttgataaggcgtttgtggcaattcaaacttatgatgaatattacaatcaagatgaattaccagaaaaagaaagaatatctataccggcattaactgatgaagaattagagcatctacaaggtgtttattctaatgttattgaaaagataagagaaaatggtggtgatggtggtaacggagataactcggatccagaatttgattgggaatatgaattgacccctatctacaacaataagatagatgaacgctatattactaatctaattcaaaatgtggtatctgatactaatgaaagtgaactgttccttaatgaaaaagatgtcgaagaaatcgatgaaactatcgataatttagaaaagataaacaaaccaaaagcagatataatcagaagtttatgggacaaagttaagcaaaatccgcaagaatatgctggaacttcgattagtcaattagtagaagatttgattaacaaggaaaaccatcgtttgatgcaagaatttgcggataaatacaaagtggattataacgatctacgttatgtaattaacaactatgtttctgatggggacagtactcgtcaaaaaggtatggcagaaatgattgatagggaagcttacgagaaatttagggatgcctatccaaatgcagagtcattgttaaagtggaagcatagaatgcgtcaagaagtagatactttctacacagacaaaataagaccactaatgtatacagaataa

SEQ ID NO: 136 - protein, 1004 aa, Lactobacillus salivarius
MDLERDIEEKLINRLTQGVSQWTRRDDIKTVSQLWDNFFKILSKNNKAQLHDQPLTENEKNTIRTQITKPNFYQAAKFMVGANRQVKFHLKREDSTLPDADLTILDNTNIAGGTSVYEVIHQIQLARKFELDQDRRSDVTLLINGLPMIHIELKKPSESIIKAFNQIQKYINEAKFTDIFCFIKMFVVSNKTITRYISAGQSLREKFLTAWVDDKNQRVDNYLDFAREVLSIPQAHHMLADYTVLDNQAKNIILLRPYQIHAIKAIFKASREQKSGYIWHTTGSGKTLTSYKVARNLLQIPSIQKTVFLIDRQDLDVQTVSAFEAYAYNDTINVDDTDNSYDLANQLIDNEKKVIVTTRQKLQAIFRRIDEQKDNLSKKYLKLKDVKLAFVVDECHRAVTPSQKKELEGFFKNSLWYGFTGTPIMDKNARAENGNDARTTKGLYGDLLHTYTIKNAIADNAVLGFQITNIGQENVEDEENTEKWDKLYLKDVHMKAVVKKILNLAYVKQGLKDGNRYAAIFTTSSIKQAQKYYHIFRDIANGESEIKVPKVIKEKAVDFPRVAITYSISQNEKDSEDNQKDMKVSLKDYNAMFGTNFEMGQIDAYNRNVNDRLARKSKQYQAPSQQLDIVIVVDRLLTGFDSPTLSTLYIDRRPMNPQNMIQAFSRTNRIYDNTKQWGQIVTFQYPETYKKKIDEAIQLYSNGAATSDITAPVWTESRKKYIAARNGINQYLLDKKALDRIVDAPMEEMKAFARDFQKFDKAFVAIQTYDEYYNQDELPEKERISIPALTDEELEHLQGVYSNVIEKIRENGGDGGNGDNSDPEFDWEYELTPIYNNKIDERYITNLIQNVVSDTNESELFLNEKDVEEIDETIDNLEKINKPKADIIRSLWDKVKQNPQEYAGTSISQLVEDLINKENHRLMQEFADKYKVDYNDLRYVINNYVSDGDSTRQKGMAEMIDREAYEKFRDAYPNAESLLKWKHRMRQEVDTFYTDKIRPLMYTE

SEQ ID NO: 137 - DNA, 1479 bp, Lactobacillus acidophilus
atggcaggtacaactactcagtttgttaagagaataagagatatcatgcgtaatgatccaggtatcaatggtgatgcgcagagaattgaacaattatcttggattttattcttgaaagtttacgatgatagagaacaaatttgggagattgatcaagatgattatgaatcaattattccgaaagggatgcactggcgtgaatgggctgaagacaataaagatggtaaagctttaactagtgatgaattactagactttgttaacaataaattattgcctacgttgaagaacatcactgtaactaatgaaactcctattagcaaggccattgtaaaagatgcttttattgatgctaacaactacatgaagaatggtgttttattgcgccaagtagttaacgtagttaatgaagttgacttcactgaccctaaggatcgtcacttatttggtgatatctatgaaagtatcttgaaagaacttcaaagtgctggtagttctggtgaattctacactccacgtgcattgactgactttattgcagaaactttgaagcctaaattagggcaaagaattgctgacctagcttgtggtactggtggcttccttgttagtgctttgaatatcttgagtaaacaagttcatagtgttgaagatagagaactgtacaataaagcagtttttggtattgaaaagaagggacaaccttatattttggctgtaactaacttgcttcttcacgatgttgataatccagatatcgttcatggaaactcacttgaaaaacgtgttactgaatatactgataaagataagtttgacttgattatgatgaatccgccatttggtggatctgagttacctattattaagcaaaactttccaactgatttgcaaagtagtgaaactgccgacttgttcttagcattgatcatgtaccgtattaaagataatggtaaagttggtgtgattttaccagatggtttcttgtttggtaatgatggtgccaagcttaacattaagaagcgtatgcttaaagacttcaatcttcatactattattcgtttgccaggtagtattttcagtccatatacatcaattgcaactaacattctgttctttgataagacaggtcctactaaagaaacttggttctatcgtttagatatgcctaagggatacaagcacttctctaagactcgtccaatgaagttagaacattttgatcctgtacgtgaatggtggaatgatcgtcatgaaattcaagatgaagatggtaactataaatctaaggcttacactcctgaagaattagctaagaataattacaatttcgatttgtgtggttttccaacagaaactgaagaagtcttgccaccttttgaattgatggataaatatcaaaaagagcgtaaggaattaaacgcaaagattgataaacaattatctattattaaacaattgcttgaggaggatgactaa

SEQ ID NO: 138 - protein, 492 aa, Lactobacillus acidophilus
MAGTTTQFVKRIRDIMRNDPGINGDAQRIEQLSWILFLKVYDDREQIWEIDQDDYESIIPKGMHWREWAEDNKDGKALTSDELLDFVNNKLLPTLKNITVTNETPISKAIVKDAFIDANNYMKNGVLLRQVVNVVNEVDFTDPKDRHLFGDIYESILKELQSAGSSGEFYTPRALTDFIAETLKPKLGQRIADLACGTGGFLVSALNILSKQVHSVEDRELYNKAVFGIEKKGQPYILAVTNLLLHDVDNPDIVHGNSLEKRVTEYTDKDKFDLIMMNPPFGGSELPIIKQNFPTDLQSSETADLFLALIMYRIKDNGKVGVILPDGFLFGNDGAKLNIKKRMLKDFNLHTIIRLPGSIFSPYTSIATNILFFDKTGPTKETWFYRLDMPKGYKHFSKTRPMKLEHFDPVREWWNDRHEIQDEDGNYKSKAYTPEELAKNNYNFDLCGFPTETEEVLPPFELMDKYQKERKELNAKIDKQLSIIKQLLEEDD

SEQ ID NO: 139 - DNA, 1569 bp, Lactobacillus amylovorus
atgattaacggcgaaattaagaataaagttgatgctttatggaatgactttgcagctggtggtttaactaatccgcttgaagttattgaacaaattacctatttaatgtttattcacgagttggatagttcagataacattcaccgaacggaaagtgaaatgttaggtattccttttaagagtatttttgagggtaaaaaagttattggtaatcaagagattgatggtagaaagttaaagtggtcagttttccgtgatcttcctgctcaacaaatgtttgatttgattagtaattgtgtatttccttttattaaggatttaccacgttatgaagagagtatggatgaaacacaagatagtgcatattctaaatatatgggggatgctgtctttaaaattccatccgcagagcttttatctaaagctgtagactcacttgatagtatttatgaaactatggacaaagttcaaaaagatgaacttgctcaagagaataaagatagaaacgataagcctgatgttcaaggtgatttatatgaatacttattaagcaagttgtcaaccgcaggtagaaatggtcaattccgtacgccacgtcatattatcaaaatgatggttaagttaatgaatccaacaccagatgacaagattgctgacccagcttgtggtacttctggattccttgttgcagctgcagaatatttaaagaataatcctgaaactgaaaaagaaattttctttaataaggaaaaaagaaattattacaagagcgacatgtttacaggatacgatatggatggaactatgttgagaattggtgctatgaatatgatgactcatggcattactaatcctaatattcaatatcgcgatagtttgtctgataaaaatgcagatcatgatgagtattctttaattttagccaatccacctttcaagggaagtcttgactacgatacagtttcagacagtttacttaaggtatgtaagactaagaagaccgaattattgttcttggctttgttcttaagaatgctaaaagtaggtggacgttgtgcatgtattgttcctgatggcgttctttttggttcatccagagcacacaaggctattagaaaacaacttgttgaagaaaatagactagaagcagttatttcaatgccttccggagtatttaagccatatgcaggagtttctactgctattttgattttcactaagactaatcatggtggtactgacaaggtatggttttatgatatgaccgctgatggttattcattagatgataagcgtactaaagttgatgaagatgatattcctgatattattgaacgctttaataatctggataaagaaatcgacagaaagagaactgaaaagtcattctttgtagataagaaagaaattgtcgataatggctacgatctatcaatcaatcgctataaagagattgaatacgttccagtaaagtatccaccaacagaagatatcttggctgaaattatgaagttagatgatgaagctaataaaaatcttcaggaattgaagaatatgcttgaaaaatag

SEQ ID NO: 140 - protein, 522 aa, Lactobacillus amylovorus
MINGEIKNKVDALWNDFAAGGLTNPLEVIEQITYLMFIHELDSSDNIHRTESEMLGIPFKSIFEGKKVIGNQEIDGRKLKWSVFRDLPAQQMFDLISNCVFPFIKDLPRYEESMDETQDSAYSKYMGDAVFKIPSAELLSKAVDSLDSIYETMDKVQKDELAQENKDRNDKPDVQGDLYEYLLSKLSTAGRNGQFRTPRHIIKMMVKLMNPTPDDKIADPACGTSGFLVAAAEYLKNNPETEKEIFFNKEKRNYYKSDMFTGYDMDGTMLRIGAMNMMTHGITNPNIQYRDSLSDKNADHDEYSLILANPPFKGSLDYDTVSDSLLKVCKTKKTELLFLALFLRMLKVGGRCACIVPDGVLFGSSRAHKAIRKQLVEENRLEAVISMPSGVFKPYAGVSTAILIFTKTNHGGTDKVWFYDMTADGYSLDDKRTKVDEDDIPDIIERFNNLDKEIDRKRTEKSFFVDKKEIVDNGYDLSINRYKEIEYVPVKYPPTEDILAEIMKLDDEANKNLQELKNMLEK

SEQ ID NO: 141 - DNA, 1674 bp, Lactobacillus amylovorus
atggctgaaactttaacgaaaactgaacttgaacatgcattatttagtgcagctgattctttgcgctcaaaaatggatgcgaatgaatataagaattacttattaggtataatcttttataagtatttgtcagataagctactgtacatagctgcagaatcgcttgaccctaattttatcgatgatagagatgatcttcctttagataaatggcaaaaaatgtatgcggagaatgctgacgatgcagaacttttatcggatcttaaagctactcttatgtacttaattagtccggaacatacttttacatacatatttaatgaaataaatggagaagctagaactaaggatggaaatttgaagacatttcagatctcagacctagcagatgcatttaatgatattgaaagtactagtaaagactttgatggattgtttaaagacgtacaattgtattctcaaaaattgggatcaaatgcgcaaaaacaagcagatactatttctgaagttattaaatctattggaaaaatcaatttaattgaacaagatgatcaaaataataaaaatgatactttaggagatgcatatgaatatcttattagagagtttgcctctgagtctggaaagaaagccggagaattttatactccacaaaaagtatcggaacttttgactaaattgacattagttggcaaaaagtatcctgaagggatgaccgtttatgatccagcaatgggctcgggatcattactgttaaactttaagaaatatatcaaagattttgctggcggtgatccgaacaaagtaatctattatggccaagaaattaatatttcaacatttaacttggctagaatgaatatgattcttcatggtgttgattcaggaaatcaacatttgagacaaggtgatactcttgatgcagattggccaccaatttctcaaactatgttcgatgctgtcgtcatgaatccaccatattcattaaagtggtcagctaataaaggtttcttacaagatccaagatttagtccctatggtgtattggcacctaagtctaaggctgactatgcgttcttattacatggtttctatcacttgaagaatacaggaacaatggccatcgttttgcctcatggagtattattccgtggagctgcagaaggtaagattcgtaagaagttattggaaaatggttcaattgatgcagtaattggtttgccagctaacttgttctataacactagtattcctactgttattcttgttctgaagaagaataaagaaaacagagatgtaatatttattgatgcatctaaaggctttgaaaagaagaaaaatcaaaatgaacttcgtgaagaagatattcaaaagatacttgatacttatgaaaagcatgaagatgtagaacgttacgctcatttggctaaatatgatgaaatcgaagaaaatgatttcaatcttaatatccctagatatgtggatactttcattcctgagccaccagttgatttaaagaaggtagcatctgatttacatgatactaatgttgaaatagagaagaatcaaaaagaattggtaggtatgcttaaagaattgacttctgatgatagtgatgtgatggatgggttagacgccatcataaaggaattggaggccgaattacatgagtaa

SEQ ID NO: 142 - protein, 557 aa, Lactobacillus amylovorus
MAETLTKTELEHALFSAADSLRSKMDANEYKNYLLGIIFYKYLSDKLLYIAAESLDPNFIDDRDDLPLDKWQKMYAENADDAELLSDLKATLMYLISPEHTFTYIFNEINGEARTKDGNLKTFQISDLADAFNDIESTSKDFDGLFKDVQLYSQKLGSNAQKQADTISEVIKSIGKINLIEQDDQNNKNDTLGDAYEYLIREFASESGKKAGEFYTPQKVSELLTKLTLVGKKYPEGMTVYDPAMGSGSLLLNFKKYIKDFAGGDPNKVIYYGQEINISTFNLARMNMILHGVDSGNQHLRQGDTLDADWPPISQTMFDAVVMNPPYSLKWSANKGFLQDPRFSPYGVLAPKSKADYAFLLHGFYHLKNTGTMAIVLPHGVLFRGAAEGKIRKKLLENGSIDAVIGLPANLFYNTSIPTVILVLKKNKENRDVIFIDASKGFEKKKNQNELREEDIQKILDTYEKHEDVERYAHLAKYDEIEENDFNLNIPRYVDTFIPEPPVDLKKVASDLHDTNVEIEKNQKELVGMLKELTSDDSDVMDGLDAIIKELEAELHE

SEQ ID NO: 143 - DNA, 1569 bp, Lactobacillus amylovorus
atgattaacggcgaaattaagaataaagttgatgctttatggaatgactttgcagctggtggtttaactaatccgcttgaagttattgaacaaattacctatttaatgtttattcacgagttggatagttcagataacattcaccgaacgggaagtgaaatgttaggtattccttttaagagtatttttgagggtaaaaaagttattggtaatcaagagattgatggtagaaagttaaagtggtcagttttccgtgatcttcctgctcaacaaatgtttgatttgattagtaattgtgtatttccttttattaaggatttaccacgttatgaagaaagtatggatgaaacacaagatagtgcatattctaaatatatgggggatgctgtctttaaaattccatccgcagagcttttatctaaagctgtagactcacttgatagtatttatgaaactatggacaaagttcaaaaagatgaacttgctcaagagaataaagatagaaacgataagcctgatgttcaaggtgatttatatgaatacttattaagcaagttgtcaactgcaggtagaaatggtcaattccgtacgccacgtcatattatcaaaatgatggttaagttaatgaatccaacaccagatgacaagattgctgacccagcttgtggtacttctggattccttgttgcagctgcagaatatttaaagaataatcctgaaactgaaaaagaaattttctttaatagggaaaaaagaaattattacaagagcgacatgtttacaggatacgatatggatggaactatgttgagaattggtgctatgaatatgatgactcatggcattactaatcctaatattcaatatcgtgatagtttgtctgataaaaatgcagatcatgatgagtattctttaattttagccaatccacctttcaagggaagccttgactacgatacagtttcagacagtttacttaaggtatgtaagactaagaagaccgaattattgttcttggctttgttcttaagaatgctaaaagtaggtggacgttgtgcatgtattgttcctgatggcgttctttttggttcatccagagcacataaggctattagaaaacaacttgttgaagaaaatagactagaagcagttatttcaatgccttccggagtatttaagccatatgcaggagtttctactgctattttgattttcactaagactaatcatggtggtactgacaaggtatggttctacgatatgacggctgatggttattcattagatgataagcgtactaaggttgatgaagatgatatccctgatattattgaacgatttaataatttagatgaagaaactgacagaaagagaactgaaaagtcattctttgtagataagaaagaaattgttgataacggctatgacttatcaattaatcgttataaagaaattgaatatgttccagtaaagtatccaccaacagaagatattttggctgaaattatgaaattagacgacgaagctaacaagaatcttcaagaattgaagaatatgcttgaaaaatag

SEQ ID NO: 144 - protein, 522 aa, Lactobacillus amylovorus
MINGEIKNKVDALWNDFAAGGLTNPLEVIEQITYLMFIHELDSSDNIHRTGSEMLGIPFKSIFEGKKVIGNQEIDGRKLKWSVFRDLPAQQMFDLISNCVFPFIKDLPRYEESMDETQDSAYSKYMGDAVFKIPSAELLSKAVDSLDSIYETMDKVQKDELAQENKDRNDKPDVQGDLYEYLLSKLSTAGRNGQFRTPRHIIKMMVKLMNPTPDDKIADPACGTSGFLVAAAEYLKNNPETEKEIFFNREKRNYYKSDMFTGYDMDGTMLRIGAMNMMTHGITNPNIQYRDSLSDKNADHDEYSLILANPPFKGSLDYDTVSDSLLKVCKTKKTELLFLALFLRMLKVGGRCACIVPDGVLFGSSRAHKAIRKQLVEENRLEAVISMPSGVFKPYAGVSTAILIFTKTNHGGTDKVWFYDMTADGYSLDDKRTKVDEDDIPDIIERFNNLDEETDRKRTEKSFFVDKKEIVDNGYDLSINRYKEIEYVPVKYPPTEDILAEIMKLDDEANKNLQELKNMLEK

SEQ ID NO: 145 - DNA, 1599 bp, Lactobacillus casei
atggctcaaatgacgtcacagacactgtaccaagcactttggaattctgccgatatcttacgatcaaagatggacgccagcgaatataagaattacttgctaggcttaattttttacaagtatctttctgatcgcatggtggtttatgcttcagatcaattggaggagaagacaacagatctggataaagcccagcaaatttacacggatgcatacaatgataaagatttgcatgatgatctgataagtaatgtttccgatgagtttggttatcacattcaacctgatctgacttttacggctctcatagacaaaatcgatcacggaacttttcagcttgaagaccttagtcagagctttcgcgatattgagcaatccagtgaattcttttctggattattcgaggatgttgatttgtattcgcgaaagctgggtgcaaccccgcaaaagcaaaatcaagttatctcggatgtcatgaagcaaatctcgacgcttgatctggtgggtcagaacacgaatgacatactcggggatgcatacgaatatttgatcggtcaatttgcgtctgattccggcaaaaatgctggtgagttttatacgccgcagtcggtgtcacgtcttattacgcaaatcgcgatgcacggtaaggaagatgtccgtggtttcacgatttatgatccgacaatgggatcaggctcactgcttctaaatgcgcgtcgctattcgaacgaacgtctgtctatcaactattttggtcaggaactgaatacgtcaacgtacaatttagcgcgtatgaacatgattcttcatggtgtgccaattaataaccagcatctacacaatgctgacaccttggatcaagactggccaattgaagaacccacaaactttgatgccgttgtgatgaacccaccatactcggctcattggcagccgtcgaaggggacggaaaacgatccccgatttgtcagctatggtctcgcaccaaaatctaaagccgacttcgccttcttgctccatggctactatcacttaaaggacactggggtaatgtgtatcgttttgcctcacggtgttcttttccgtggtggtgcagaggggcgtattcgtaaagcgttacttgaaaacggtgcgatcgacacggtgattggtttgcctgcaaacatcttctttaacacgagcattccaaccacagtcacggtcttgaaaaaatctcgaacgactcgcgatgtgctctttattgatgcatcaaaagagttcgagaaggctaagaaccaaaatcatctgacagacgacaacatccaaaagattcttgaaacgtgtattaatcgcaaggatgttgataagtatgcccatctcgcatccttcgatgagatcaaggaaaatgactttaacttaaatattccgcgttatgttgatacgacagaaccagaaaagccagttgatgtggtcaaagtggttgctgatatcaagaaaaacgatgaagaaattgcaagattaagttcggagctagccaaaaattttgacgatttagtggctaataatgacgaagctgccaagcaactcactgccttgaaggagttgtttaaaaatgagtaa

SEQ ID NO: 146 - protein, 532 aa, Lactobacillus casei
MAQMTSQTLYQALWNSADILRSKMDASEYKNYLLGLIFYKYLSDRMVVYASDQLEEKTTDLDKAQQIYTDAYNDKDLHDDLISNVSDEFGYHIQPDLTFTALIDKIDHGTFQLEDLSQSFRDIEQSSEFFSGLFEDVDLYSRKLGATPQKQNQVISDVMKQISTLDLVGQNTNDILGDAYEYLIGQFASDSGKNAGEFYTPQSVSRLITQIAMHGKEDVRGFTIYDPTMGSGSLLLNARRYSNERLSINYFGQELNTSTYNLARMNMILHGVPINNQHLHNADTLDQDWPIEEPTNFDAVVMNPPYSAHWQPSKGTENDPRFVSYGLAPKSKADFAFLLHGYYHLKDTGVMCIVLPHGVLFRGGAEGRIRKALLENGAIDTVIGLPANIFFNTSIPTTVTVLKKSRTTRDVLFIDASKEFEKAKNQNHLTDDNIQKILETCINRKDVDKYAHLASFDEIKENDFNLNIPRYVDTTEPEKPVDVVKVVADIKKNDEEIARLSSELAKNFDDLVANNDEAAKQLTALKELFKNE

SEQ ID NO: 147 - DNA, 1599 bp, Lactobacillus casei
atggctcaaatgacgtcacagacactgtaccaagcactttggaattctgccgatatcttacgatcaaagatggacgccagcgaatataagaattacttgctaggcttaattttttacaagtatctttctgatcgcatggtggtttatgcttcagatcaattggaggagaagacaacagatctggataaagcccagcaaatttacacggatgcatacaatgataaagatttgcatgatgatctgataagtaatgtttccgatgagtttggttatcacattcagcctgatctgacttttacggctctcatagacaagatcgatcacggaacttttcagcttgaagaccttagtcagagttttcgcgatattgagcaatccagtgaattcttttctggattattcgaggatgttgatttgtattcgcgaaagctgggtgcaaccccgcaaaagcaaaaccaggttatctcggatgtcatgaaacaaatctcgacgcttgatctggtgggtcagaacacgaatgacatactcggggatgcatacgaatatttgatcggtcaatttgcctctgattccggcaaaaatgctggtgagttttatacgccgcagtcggtgtcacgtcttattacgcaaatcgcgatgcacggtaaggaagatgtccgtggttttacgatttatgatccgacaatgggatcgggttcactgcttctaaatgcgcgtcgctattcgaacgaacgtctgtctatcaactactttggtcaggaactgaatacgtcaacgtacaatctagcgcgtatgaacatgattcttcatggtgtgccaattaataaccagcatctacacaatgccgataccttggaccaagattggccaattgaagaaccaacaaactttgatgcagttgtgatgaacccaccgtactcagcgcattggcagccgtcgaaggggacagaaaacgatccccggtttgtaagctatggtcttgcaccaaaatctaaagccgactttgccttcttacttcatggctactatcacttaaaggacactggggtaatgtgtatcgttttgcctcacggtgttcttttccgtggtggtgcagagggtcgcattcgtaaagcattactcgaaaacggcgcgatcgacacggtgattggtttgcctgcaaacatcttctttaacacgagcattccaaccacagtcacggtcttgaaaaaatctagaacgactcgcgatgtgctctttattgatgcatcaaaagagttcgagaaggctaagaaccaaaaccatctaacagacgacaacatccaaaagattcttgaaacgtatatcaatcgcaaggatgttgataagtatgcccatctcgcatccttcgatgaaatcaaggaaaatgactttaacttaaatattccacgttatgttgatacgacagaaccagaaaagccagttgatgtggtcaaagtggttgctgatatcaagaaaaacgatgaagaaattgccagattaagttcggagttagccaaaaattttgacgatttagtggccaataatgacgaagctgctaagcaactcgctgccttgaaggagctgtttaaaaatgagtaa

SEQ ID NO: 148 - protein, 532 aa, Lactobacillus casei
MAQMTSQTLYQALWNSADILRSKMDASEYKNYLLGLIFYKYLSDRMVVYASDQLEEKTTDLDKAQQIYTDAYNDKDLHDDLISNVSDEFGYHIQPDLTFTALIDKIDHGTFQLEDLSQSFRDIEQSSEFFSGLFEDVDLYSRKLGATPQKQNQVISDVMKQISTLDLVGQNTNDILGDAYEYLIGQFASDSGKNAGEFYTPQSVSRLITQIAMHGKEDVRGFTIYDPTMGSGSLLLNARRYSNERLSINYFGQELNTSTYNLARMNMILHGVPINNQHLHNADTLDQDWPIEEPTNFDAVVMNPPYSAHWQPSKGTENDPRFVSYGLAPKSKADFAFLLHGYYHLKDTGVMCIVLPHGVLFRGGAEGRIRKALLENGAIDTVIGLPANIFFNTSIPTTVTVLKKSRTTRDVLFIDASKEFEKAKNQNHLTDDNIQKILETYINRKDVDKYAHLASFDEIKENDFNLNIPRYVDTTEPEKPVDVVKVVADIKKNDEEIARLSSELAKNFDDLVANNDEAAKQLAALKELFKNE

SEQ ID NO: 149 - DNA, 1617 bp, Lactobacillus casei
atgtcagaaaaaacaacgcaagctagtcaacttgaaagcgccctatggaatgcggccgatgtcttacgcgggaaaatggacgcttctgaatataaaaattatttattggggttaattttttatcggtttctatctgagaaaaccttaacgacctttagtgattgggcaggcgaaaccgaaaatgtcacccggaaatatgctcagtatatggatcctcagtttgaattggaaggcgtctcggtgcagcccagtttagtggagtatttgcaaaacacgctcggctatttaattcaaccacaagcgttgtacaccaccctgattggcaagattcaagcccatacttttgcgttagacgatttatctcaagcacttcatgatctggaacagtcgacacaaaatctatcttcagcgcaagacttttcgggcttgtttgccgatgtggatttaagtagtaataaattaggcagttctttacaacaacggaatcaaactatcagtgataccatgttagctttaaatgcgattgatctcgtccatcatcaaggcgacgtcttaggtgacgcctatgaatacttaatcgcgcaatttgccagtgattctggtaagaaggcgggtgaattttatactccacggcaggtgtccgacattattgcccagattgtgacttatcagcgcaatgcaggtgacaaccaagtgcggactatctatgatccagcggttggttccggttcactgctattaaatgtcggacagcacgtgcaagaccccaatttagtgagttatcacggccaagaattgaacaccacgacctataacctggcccgtatgaacctaatgttacatggagtctcgtatgacgatatgcacttacgcaatggtgacacgttaagtaaagattggccggttgacgaaccttacttatttgatgcggtcgtcatgaacccgccctactcggcacactgggataacagtgataaacgcttgtctgatccccgtttccgcgactatggcgtcttaccacctaaatctaaagccgactttgcctttctgctacacggcttttatcatttgcaggaacacgggactatgggcattgtcttaccccatggcgtgctatttcggggggctaaggagggcaaaatccggcaaaaactattaatggataaccggattgatgccattattgggctacctgccaatatttttcattccactggtattccaacgttaatcatgattttaaagaaacacaaaaccactgacgacgtcttgtttattgatgcgtcccgggaatttgaaaaggacaagaatcaaaataagctaacggcagcgaatattcaaaaaattgtgaccacttatcaaaaccggcaagatgttgataaatatgctcatgtggcctcaccggcggaaatcaaggaaaatgattataatttaaatattccgcgctacgttgatacgtttgaaccggaacccgagattgatctgaaccaagttaaagctgatctgaagcaactggacgaggaaatcagtcagaatgagcaagcctttaatgaattagctagccagttagtgaccacccaggttaatgaccagtcaaaaccggaggcccacaaatga

SEQ ID NO: 150 - protein, 538 aa, Lactobacillus casei
MSEKTTQASQLESALWNAADVLRGKMDASEYKNYLLGLIFYRFLSEKTLTTFSDWAGETENVTRKYAQYMDPQFELEGVSVQPSLVEYLQNTLGYLIQPQALYTTLIGKIQAHTFALDDLSQALHDLEQSTQNLSSAQDFSGLFADVDLSSNKLGSSLQQRNQTISDTMLALNAIDLVHHQGDVLGDAYEYLIAQFASDSGKKAGEFYTPRQVSDIIAQIVTYQRNAGDNQVRTIYDPAVGSGSLLLNVGQHVQDPNLVSYHGQELNTTTYNLARMNLMLHGVSYDDMHLRNGDTLSKDWPVDEPYLFDAVVMNPPYSAHWDNSDKRLSDPRFRDYGVLPPKSKADFAFLLHGFYHLQEHGTMGIVLPHGVLFRGAKEGKIRQKLLMDNRIDAIIGLPANIFHSTGIPTLIMILKKHKTTDDVLFIDASREFEKDKNQNKLTAANIQKIVTTYQNRQDVDKYAHVASPAEIKENDYNLNIPRYVDTFEPEPEIDLNQVKADLKQLDEEISQNEQAFNELASQLVTTQVNDQSKPEAHK

SEQ ID NO: 151 - DNA, 1599 bp, Lactobacillus casei; identical to SEQ ID NO: 147

SEQ ID NO: 152 - protein, 532 aa, Lactobacillus casei; identical to SEQ ID NO: 148

SEQ ID NO: 153 - DNA, 1617 bp, Lactobacillus casei; identical to SEQ ID NO: 149

SEQ ID NO: 154 - protein, 538 aa, Lactobacillus casei; identical to SEQ ID NO: 150

SEQ ID NO: 155 - DNA, 1599 bp, Lactobacillus casei; identical to SEQ ID NO: 147

SEQ ID NO: 156 - protein, 532 aa, Lactobacillus casei; identical to SEQ ID NO: 148

SEQ ID NO: 157 - DNA, 1623 bp, Lactobacillus coryniformis
atgtcagaaaaaacaatgcaagctagtcaacttgaaagcgccctatggaatgcggccgatgtcttacgcgggaaaatggacgcttctgaatataaaaattatttattggggttaattttttatcggtttctatctgagaaaaccttaacgacctttagtgattgggcaggcgaaaccgaaaatgtcacccggaaatatgctcagtatatggatcctcagttcgagttggaaggcgtctcggtgcagcccagtttagtggagtatttgcaaaacacgctcggctatttaattcaaccacaagcgttgtacaccaacctgattggcaagattcaagcccatacttttgcgttagacgatttatctcaagcacttcatgatctggaacagtcgacacaaaatctatcttcagcgcaagacttttcgggcttgtttgccgatgtggatttaagtagtaataaattaggcagttctttacaacaacggaatcaaactatcagtgataccatgttagctttaaatgcgattgatcttatccatcatcagggcgacgtcttaggtgacgcctatgaatacttaatcgcgcaatttgctagtgattctggtaagaaggcgggtgaattttatactccacggcaggtgtccgacattattgcccagattgtgacttatcagcgcaatgcaggtgacaaccaattgcggactgtctatgatccagcagttggttctggttctctgctgttaaatgtcggacaacacgtgcaagaacctggtttagtgagttatcacggccaagaattgaacaccacgacctataacctggcccgtatgaacctaatgttacatggagtctcgtatgacgatatgcacttacgcaatggtgacacgttaagtaaagattggccggttgacgaaccttacttatttgatgcggtcgtcatgaacccgccctactcggcacactgggataacagtgataaacgcttgtctgattcccgtttccgcgactatggcgtcttaccacctaaatctaaagccgactttgcctttctgctacacggcttttatcatttgcaggaacacgggactatgggtattgtcttaccccatggcgtgttatttcggggggctaaagaaagcaagattcgccaaaagctcctgttagataaccggattgatgccattattggactacccgccaatatttttcattccactggtattccaacgttaatcatgattttaaagaaacacaaaaccactgacgacgtcttgtttattgatgcgtcccgggaatttgaaaaggacaagaatcaaaataagctaacggcagcgaatattcaaaaaattgtgaccacttatcaaaaccggcaagatgtcgataaatatgcccatgtggcctcaccggcggaaatcaaggagaatgactacaacttaaatattccgcgctacgttgatacatttgaaccggaacccgagattgatctgaaccaggtcaaagctgatctaaagcaactggacgaggaaatcagtcagaatgaacaagcctttaatgaattagctagccagttagtgaccacccaggttaatgatcagtcaaaaccggaggctcacaatgaaagataa

SEQ ID NO: 158 - protein, 540 aa, Lactobacillus coryniformis
MSEKTMQASQLESALWNAADVLRGKMDASEYKNYLLGLIFYRFLSEKTLTTFSDWAGETENVTRKYAQYMDPQFELEGVSVQPSLVEYLQNTLGYLIQPQALYTNLIGKIQAHTFALDDLSQALHDLEQSTQNLSSAQDFSGLFADVDLSSNKLGSSLQQRNQTISDTMLALNAIDLIHHQGDVLGDAYEYLIAQFASDSGKKAGEFYTPRQVSDIIAQIVTYQRNAGDNQLRTVYDPAVGSGSLLLNVGQHVQEPGLVSYHGQELNTTTYNLARMNLMLHGVSYDDMHLRNGDTLSKDWPVDEPYLFDAVVMNPPYSAHWDNSDKRLSDSRFRDYGVLPPKSKADFAFLLHGFYHLQEHGTMGIVLPHGVLFRGAKESKIRQKLLLDNRIDAIIGLPANIFHSTGIPTLIMILKKHKTTDDVLFIDASREFEKDKNQNKLTAANIQKIVTTYQNRQDVDKYAHVASPAEIKENDYNLNIPRYVDTFEPEPEIDLNQVKADLKQLDEEISQNEQAFNELASQLVTTQVNDQSKPEAHNER

SEQ ID NO: 159 - DNA, 1593 bp, Lactobacillus coryniformis
atggcattaacagcagataaacaagcattaatttggaaaacattgaacgagactcgcggtaagattgaaccttctgaatataagaactacgtttttggtttgatgttctataagttcttatctgaaaaggcccaaacatggctggatagccagttgcgtggcgaaacttggtcatcagtttgggagcaaaacccagaaaaagcggcagcttttatgcaaaccaagttagggtatgtgattcaaccaggtgaactctttagtgactggcaagcagccattaacgtggatcaattcaacattaccaacgtggcagatgcgttggggcactttaaccaaggcattcaaccaggggccaaggccacttttgaaggcatttttgacgacatggatttgacttcaagccgtcttggtagcaatacgcagacgcgtacgaagaccttgatggattggattagtttaattgaccaaatcgaattggacgaagatgccgatgtgttgggtgatctatacgaatacttgattgggatgtttgcggctaattctggcgctaaggctggggagttctatacgccacaccaagtgtccgatattatggcgcggatcctaacggctggtcgtgaagatatgccaacgtacagcctctatgacccagccatgggatcagggtcattgcttttgacgactgcttcatacatgaagaatgatggtgttcgtggggccattaagtactacggccaagaagttatcacaaccacctataacttgggccgaattaacttgatgatgcacggggtggagtataacgatatcaatgtccataatgcagataccttgagttcagactggccggatggtgtccaaagtggggttgatagcccgcgtatgtttgatgccgtgatggccaaccctccttactcactgaagtgggataacacgaaccgagaagacgacccgcgtttcaaggccggcattgcgcctaaatcaaaggctgactttgcgttcttacaacatggtctatatcacttgaagcaagatggccgcatggcgattgttttgccacacggggtgttgttccgtggtgcggcagaaggtcgtattcgccaagcattactcgaaagtcgcaatatttcagcggtgattgggttaccccaaaagatctttacgaatacggggattccaaccattattatgattttggaaaagaaccggacgactgatgatgtgctctttattgatgcttcaaagggctttgaaaagcagaagaacaataacaagttgcgccaagaagacgtggacttaattgtggagacgttcttaaagcgtgaagacgttgctaagtatgcgcacgtggccagctttgacgagattaaggaaaatgactttaacctcaacattccacgttatgtggacacgttcgaagaagaagaacctgttgatttggtggctgttagccaggatatcgttgatgttaatcgtgatattgcgcaaagtgaagctgacttattagcgatgattagtgatttagccgtgaccgatgatagtcaggcgattatcgcatcagctaagcaattatttggaggcaagcatgagtaa

SEQ ID NO: 160 - protein, 530 aa, Lactobacillus coryniformis
MALTADKQALIWKTLNETRGKIEPSEYKNYVFGLMFYKFLSEKAQTWLDSQLRGETWSSVWEQNPEKAAAFMQTKLGYVIQPGELFSDWQAAINVDQFNITNVADALGHFNQGIQPGAKATFEGIFDDMDLTSSRLGSNTQTRTKTLMDWISLIDQIELDEDADVLGDLYEYLIGMFAANSGAKAGEFYTPHQVSDIMARILTAGREDMPTYSLYDPAMGSGSLLLTTASYMKNDGVRGAIKYYGQEVITTTYNLGRINLMMHGVEYNDINVHNADTLSSDWPDGVQSGVDSPRMFDAVMANPPYSLKWDNTNREDDPRFKAGIAPKSKADFAFLQHGLYHLKQDGRMAIVLPHGVLFRGAAEGRIRQALLESRNISAVIGLPQKIFTNTGIPTIIMILEKNRTTDDVLFIDASKGFEKQKNNNKLRQEDVDLIVETFLKREDVAKYAHVASFDEIKENDFNLNIPRYVDTFEEEEPVDLVAVSQDIVDVNRDIAQSEADLLAMISDLAVTDDSQAIIASAKQLFGGKHE

SEQ ID NO: 161 - DNA, 483 bp, Lactobacillus coryniformis
cagttaccgcatggtgttctattcagaggatcagcggaagcaaaaattcgtcagtacttgcttgaacgcaactatattgaagcagtgattggtttgccagctaatttacaaagcacaacttcaatcccaactatgattctagtattacggaagaatcgaaaacgcaaagacgtattgttcattgatgcaagtgatgatgaggttaaaaaagcacgttcacgtgatttgttgtcaacttcagcagttaacaagattgttgaaacatatcacaaattcgttagcattcagcgatatgcgtatgtagctacaccgaaagagatcattgaaaatgattataatttaaacattccacgctacgtagatacttatatcccgcctaagctaatttctgtgtctgagttggaaaataaaatagtaaagatcgatcagcaattatcaaccctagaagctgatagccgacttatcatgatgaagtatcagtag

SEQ ID NO: 162 - protein, 160 aa, Lactobacillus coryniformis
QLPHGVLFRGSAEAKIRQYLLERNYIEAVIGLPANLQSTTSIPTMILVLRKNRKRKDVLFIDASDDEVKKARSRDLLSTSAVNKIVETYHKFVSIQRYAYVATPKEIIENDYNLNIPRYVDTYIPPKLISVSELENKIVKIDQQLSTLEADSRLIMMKYQ

SEQ ID NO: 163 - DNA, 1020 bp, Lactobacillus coryniformis
atgtcagtaaagagtaatgaattaggaattgaagacaaactgtggagtgcagcagaaaagttacgaggctcaatggacgcatcaacgtatcgaaacgttgttttgggattgattttcttaaaatatgtatcagatacatttgaagaattgcatgcagaattgttagcttctaattatccagaagaggcagaagaacgcgatagttacgatgctaaaaatgttttttggctaccttcagaggcacgttggtcagtaattgccgccgctgctaaaacaccagaagttggcactacaattgataaagcaatgactgcaattgagcgtgagaactctagtgtaaagggggtcttacctaaaaattatgcttcgccagatttagctaaggaaaatctgggtgaagtcatcgatttgttctcggacgttcaggttggaaatgaagaatctcgaaaaaatgacgtattaggccgcgtatatgaattctttttacgtaaatttgcaactaatggagatggtgaattctacacgccgcgttccattgttagaacactcgtcgatatgattgaaccgtttaaaggatcgatctatgatccttgttgcggttctggtggcatgtttgtgcaatctgaagagttcgtacgtgaacaccaagggactattctagacttgtctgtttatgggcaggaatggaatccaaccacttggcgcttagctaaaatgaatttagctattcatggcattgataacaacttaggccctcgtaatggcaatacactattaaatgatttacacaagggcgaacgctttgattttgccttagcaaatccgccatttaacgtaaaagactggggagctgagaaggttattgacgactcacgctggcgctggggaactccttatgatggaaatgccaactatgcttggattgaacacatcttgagtaaattgaccccagatggtaaggctggcatcgtcctggctaatggttccttatcaacatcgactggcgatgagaaggctatt

SEQ ID NO: 164 - protein, 340 aa, Lactobacillus coryniformis
MSVKSNELGIEDKLWSAAEKLRGSMDASTYRNVVLGLIFLKYVSDTFEELHAELLASNYPEEAEERDSYDAKNVFWLPSEARWSVIAAAAKTPEVGTTIDKAMTAIERENSSVKGVLPKNYASPDLAKENLGEVIDLFSDVQVGNEESRKNDVLGRVYEFFLRKFATNGDGEFYTPRSIVRTLVDMIEPFKGSIYDPCCGSGGMFVQSEEFVREHQGTILDLSVYGQEWNPTTWRLAKMNLAIHGIDNNLGPRNGNTLLNDLHKGERFDFALANPPFNVKDWGAEKVIDDSRWRWGTPYDGNANYAWIEHILSKLTPDGKAGIVLANGSLSTSTGDEKAI

SEQ ID NO: 165 - DNA, 1458 bp, Lactobacillus crispatus
gtgaaaaatcaagaaatcgttcaaaagttgtggaatgagtgtaacgtcctgcgggatgatggtgttagttaccaagactacattactgaattaacttatatattgttcttaaaaatgagcaaagaacaaggtgaagagaacgatattccagaaaaataccgttgggataaccttgtttcaaaggacggcttagaattaagtaacttctataagcaactattacttgatttaggtaatcctcaagttgttaaaagttctagaattaacgcaatctatgcagatgcatctacttcaattcataagccagcaagtctagaaaagattattaaagatattgatggcctagattggtggtcagctagagatgagggcttaggtgatctttatgaaggcttgatggaaaagaatgcaaatgaagttaagtccggagctggtcaatactttacaccacgtgtattgattaatatgatggtaagaatgacacggcctaaattaggagatcgttgtaatgacccggctgctggtacctttggatttatggtagcagctgatcagtatcttaaagataaaaatgatgactactcatctttatctgaagaaaaaggtgagtttcaagttaatgaagctttctccgggatggagcttgttgaaactactcatcgtttggctttaatgaatcaatatcttcatgggatgaatgggcgattagaattaggagattctctttcagcaaacggtaattggatgaagaattttgatgttgtcttaaccaatcctccatttggtaccaaaaagggaattgataacgataaagcggctagtcgtgacgatattacctttgagacttcaaacaagcaacttaacttcttgcaaattatctacaattcacttaagcacgatggtaaagctagagcagccgtagttgtgccagataatgtattgtttgcggatagcgttggtgaagcaattagaaaagacttgctcaacaagtgtaacttgcatactatcttgagattgcctactgggattttctacgctcaaggtgtgcagactaatgtgttgttttttactcgcggtgaaagtgacaaggataataccaaggaaacttggatttatgatatgcgtcaccagatgcggtcatttggtaagcgtaatccattaaatgaaaaggattttgcggaatttgaaaaactattctgcgttgatgaccgctcaaagagaaaagaaacttgggataaagataagaatcctaatggtagatggcgtaagtttacgattgatgaaattttgaagcgccctaatattagtcttgatatttcttggatgaatgatgaagaagagcacgataaccgttcgttgaaagaaatcttagatgagatgaatgacaagtctaaggcaattagggatgcaattgcagaacttaataaggcattagaaggaattgacgatgaagactaa

SEQ ID NO: 166 - protein, 485 aa, Lactobacillus crispatus
MKNQEIVQKLWNECNVLRDDGVSYQDYITELTYILFLKMSKEQGEENDIPEKYRWDNLVSKDGLELSNFYKQLLLDLGNPQVVKSSRINAIYADASTSIHKPASLEKIIKDIDGLDWWSARDEGLGDLYEGLMEKNANEVKSGAGQYFTPRVLINMMVRMTRPKLGDRCNDPAAGTFGFMVAADQYLKDKNDDYSSLSEEKGEFQVNEAFSGMELVETTHRLALMNQYLHGMNGRLELGDSLSANGNWMKNFDVVLTNPPFGTKKGIDNDKAASRDDITFETSNKQLNFLQIIYNSLKHDGKARAAVVVPDNVLFADSVGEAIRKDLLNKCNLHTILRLPTGIFYAQGVQTNVLFFTRGESDKDNTKETWIYDMRHQMRSFGKRNPLNEKDFAEFEKLFCVDDRSKRKETWDKDKNPNGRWRKFTIDEILKRPNISLDISWMNDEEEHDNRSLKEILDEMNDKSKAIRDAIAELNKALEGIDDED

SEQ ID NO: 167 - DNA, 1617 bp, Lactobacillus curvatus
atgagtgagataacaacattacaagacatcactaagaaattatgggcaatggccaatgaactccggggaaatatggacgctggtgaatttaagaattatatcttagcctttatgttttatcggtacctttcagaacatcaggaacaatatttagtttctaataatgtgattgatgttgccgatgggcagacaattaatcaagcttatgtcgaacaagcaacggcagatgaattagctgattatcttgaagatatttcgtcaagtttaggttatgcgattgcgccagctaatacgtggcaatcattaaatgaacgaattgaaaatagcacggttattccaagtgattatcaaacgatttttgataatttcaataaaaatgcggtcttaaatcaagaggctgctcaagatttcaacggggtctttaacgacattaatctcggtgattcgcgcttaggtagttcaacgacggcacgtgctaaatccttgaataatattgtcaaattagttgatgatatcgaatataagagtgatgaagataaagatattctaggtgaaatttatgaatacttaattggacaattcgcggccagtgccgggaaaaagggtggcgaattctatacaccacaccaagtcagcaagattcttgctaaattagtcacgatggatgtcgcacctagcaacactgccttctcagtatatgatccaactatgggatctggctcattgttactaaccgttcgcaatcaattgcctgaagctatccgctccggagcaattaagttctatggtcaggaattaaatacaacgacctacaacttggcgcgtatgaatttaatgatgcatgatgtgtcatttaataatatgactttaaacaatgctgatacactcgaaagtgattggccagatggaccggatgaagcaggtgtcgatcaaccacggagttttgacgcagtggttgctaacccaccatattcagcaaaatgggataataatgaaacgaaactaaaagacccccgttttagcgaatatggcaaactagcaccagcttccaaagccgattttgcatttgtgttgcatagtctctaccatttaaataatgaagggacaatggcgattgtattaccacacggtgtgttattccggggtgccgctgaagggaagattcggcaaacattgattgaaaagaattatttagatgccgtcattggcctaccagctaacctattttatggcacaagtattccaaccacaattcttgtttttaagaaaaaccgccaagtgaaagacgttctattcattgatgcaagtagtgacttcgagaaagctaagaatcaaaataacttgcgagatagcgatgttgataagattgtcgctgcatacaagagtagggaagatgtcgataaatacgcccatgttgcaactttagacgaaatcaaggaaaacgattttaaccttaatataccgcgttatgtagacacttttgaagaagaagaaccaatcgacattgatgaagtcaaaaaagaaattgcagccattgatttagaaattgcaaaattagaaaaagaatttgcagaaatggaagcacagctcgtatcaacgaaaaaggagtctgattaa

SEQ ID NO: 168 - protein, 538 aa, Lactobacillus curvatus
MSEITTLQDITKKLWAMANELRGNMDAGEFKNYILAFMFYRYLSEHQEQYLVSNNVIDVADGQTINQAYVEQATADELADYLEDISSSLGYAIAPANTWQSLNERIENSTVIPSDYQTIFDNFNKNAVLNQEAAQDFNGVFNDINLGDSRLGSSTTARAKSLNNIVKLVDDIEYKSDEDKDILGEIYEYLIGQFAASAGKKGGEFYTPHQVSKILAKLVTMDVAPSNTAFSVYDPTMGSGSLLLTVRNQLPEAIRSGAIKFYGQELNTTTYNLARMNLMMHDVSFNNMTLNNADTLESDWPDGPDEAGVDQPRSFDAVVANPPYSAKWDNNETKLKDPRFSEYGKLAPASKADFAFVLHSLYHLNNEGTMAIVLPHGVLFRGAAEGKIRQTLIEKNYLDAVIGLPANLFYGTSIPTTILVFKKNRQVKDVLFIDASSDFEKAKNQNNLRDSDVDKIVAAYKSREDVDKYAHVATLDEIKENDFNLNIPRYVDTFEEEEPIDIDEVKKEIAAIDLEIAKLEKEFAEMEAQLVSTKKESD

SEQ ID NO: 169 - DNA, 2025 bp, Lactobacillus delbrueckii
atggacaatcaggaatataactcgatagtcagctttatttggggaatcgctgatgattgccttagggacgtatatgtaagaggaaaatatcgtgacgtcatccttccgatgacagtcattcgtcgccttgacgcaatgcttgaggagacaaagcctgcagtactggaaatgaagaaacaactggatgctgcgaagattgacaatcagtggcctgcactctgtaatgctgcaggacaggcattctgcaatgcgtctccattcctgctgaaggatttgacaagccgaggcaaaaaacagacactggaagctgactttaaagcataccttgatgggttctctccgaatgttcaggagatcctcgacaagttcaagttccgtgatcagatcaggacgatggtggacgcagacatcctcgggtcagtcatcgacaagttcacctctgcggacatcaatctcagccccaaccctgtctacaaggatgctgagaaaaccatcgtgaaacttccagggcttgataaccacggtatgggaaccatttttgaggagcttatccgccgctttaatgaagaaaacaatgaggaagccggagaacactggacacctcgtgatgttgtcgaattgatggccgacctagctatgattcctgtggaagacaaaataaaggacgcctcctactcatgctatgacggagcctgcgggacggggggaatgcttaccgttgcccaagacagacttttgaaaaccgcagctcgtagaggcaagaatgtctccattcacttgttcggtcaggaaatcaatccggaaacttatgctatctgcaaggcagatatgctccttaaaggtgatggcgaggaagcagaacatatcgcttatggatctactctgtcacttgacgctaatccgtcacggcagtttgatttcatgctctccaatccgccgtacggcaagagttggaaaacagatgcagacaagatgggtggcaagagtgaaatcctagacactcgtttcaatgcatacctttccggtggtgaagagctaaagatgatcccgcgcacaagcgacggacagcttctcttcctgctcaacaacgtatccaagatgaaaaccgacacagaactcggcagccgcatcatcgaagtacataacggctcatccctgtttacgggcgacgcaggaagcggcgaaagcaacgcacgcagatatctaatcgagcgcgatcttgtggaagctatcatcgcattgcctgacaacatgttctacaacacaggcattggcacatacatttgggtgctttccaataagaaggaagaacgccgcaaaggcaagattcaactcatcgacgcgacaaatatgaagtcttcgctgcgcaagaacatgggcaataagaactgcgaattcacgccggaaatccgtaaggaaattgtccgtatcttcctcgacatggaggaaagcgatgtaagcatgatattcgataacagtgagttcggctactggaatgtaactgtcgagcgtcctctacgtctccatgtattcccggaacgagaaatccctgaaaaaaatgaaaaggggaagcttttgtttaagaaagccacagatctagaaatggtgagaaaggcggtcgccgatgtgccgaaggacacaccgcttgacgattgggaagcttttgccaaggcgacaaagcttaagaagacacagctcaagaagatccgtccgtttatcacggaagctgatccacatgcaaaagaggttgaaggcgaatccgatccgaacctccgcgactcggaaaacatcccgttcaactacgatggtggaatcgatgcgttcatcgaaaaggaagtcaagccatatgcgccggacgcctacgtggatgaaagcaagacgaagatcggttacgagatcagcttcacgaagtacttctacaagcctgtgcaactccgtgacatgaaagacatccttgcctccctcgcggaacttgaaaaggagtctgatggtgtgatggatgagatcatagagggactggagtaa

SEQ ID NO: 170 - protein, 674 aa, Lactobacillus delbrueckii
MDNQEYNSIVSFIWGIADDCLRDVYVRGKYRDVILPMTVIRRLDAMLEETKPAVLEMKKQLDAAKIDNQWPALCNAAGQAFCNASPFLLKDLTSRGKKQTLEADFKAYLDGFSPNVQEILDKFKFRDQIRTMVDADILGSVIDKFTSADINLSPNPVYKDAEKTIVKLPGLDNHGMGTIFEELIRRFNEENNEEAGEHWTPRDVVELMADLAMIPVEDKIKDASYSCYDGACGTGGMLTVAQDRLLKTAARRGKNVSIHLFGQEINPETYAICKADMLLKGDGEEAEHIAYGSTLSLDANPSRQFDFMLSNPPYGKSWKTDADKMGGKSEILDTRFNAYLSGGEELKMIPRTSDGQLLFLLNNVSKMKTDTELGSRIIEVHNGSSLFTGDAGSGESNARRYLIERDLVEAIIALPDNMFYNTGIGTYIWVLSNKKEERRKGKIQLIDATNMKSSLRKNMGNKNCEFTPEIRKEIVRIFLDMEESDVSMIFDNSEFGYWNVTVERPLRLHVFPEREIPEKNEKGKLLFKKATDLEMVRKAVADVPKDTPLDDWEAFAKATKLKKTQLKKIRPFITEADPHAKEVEGESDPNLRDSENIPFNYDGGIDAFIEKEVKPYAPDAYVDESKTKIGYEISFTKYFYKPVQLRDMKDILASLAELEKESDGVMDEIIEGLE

SEQ ID NO: 171 - DNA, 1599 bp, Lactobacillus delbrueckii
atggcagaagaaaattcaacagttagcttgcagagtggtttgtttgcagctgcagacgtcttgcgttcaaagatggacgccaatgagtataagaactatcttttggggactgttttctataagtacctttcagaccagcagctttacaagttggctgaagacgccggtgaagatgatgttactttagacaaggctcagaaaatctatgaggaaaaccttgaagaagaagacctactggaagaggttaaagacgagcttggatatttgatcgagccggaatacacctacaccaagatcttagataatgccaacgatggcagtttccaactcaatcagttaggggatgcctttaacaagctagaaagtcaaggcagcagttttgaaggcttgtttgacgactatgacctgtattcaaagcggctgggtcaaaacttgcagaagcagacagatacaattgccggagtgattaaggcgatcggcaaattagaactggttaagactcctggtgacaccttgggggatgcttacgaatacttgatcagtcaatttgcctcagaatcaggtaagaaggccggtgagttctatactccgcaagaagtttctgaacttttagcacggttaactttagtcggtaaggattactcttctgggatgagcgtttacgacccggcgatgggatcaggttcactgctgctgaactttagaaagtatgttccaaactcatcaagaattacttattacgggcaggaaatcaacacatcaacctttaacttggctagaatgaacatgattttgcaccacgttgatctggcaaaccagaagttgagaaacggggatacgttagacgaggactggccagctgaagaaaccactaacttcgactcagttgtcatgaacccgccatattcacttaaatggaacgcggacaagggcttcttggatgacccacgtttttctaaatacggtgttttgccgccaaagtctaaggcggactatgctttcttgcttcacggcttctaccacttgaaacacagtggggcaatggctatcgttctgccacacgggattcttttccgtggtgcagcggaaggaaagatccggcaaaagttgcttgaagagggcgcgattgatgcagtaataggtttgcctgcaaacttgttttactcaactggtatcccaactactattgtcgttcttaagaaggacaagcaggatcggagcgtgctgtttattgacgcatctaaggagttcgaaaaggttaagactcagaataagttgcggcaagaagacattgataagatcttgaagacatatgaagaacgaccagtagatgttgagaagtatgcccacttagcaagttttgatgagatcaaagaaaatgacttcaacttgaacattcctcgttacgttgatacttttgagccagaaccagaaattgatctgcgggacgtggctaaggagctgcgggatattgatcaacagatcaatgaaaacgagaaagaattggtagggatgcttaaggaattgacttcaagtgacgatgatatcatggcaggtttgcagagcatcatcgaagattttgaggaggaaatccgctaa

SEQ ID NO: 172 - protein, 532 aa, Lactobacillus delbrueckii
MAEENSTVSLQSGLFAAADVLRSKMDANEYKNYLLGTVFYKYLSDQQLYKLAEDAGEDDVTLDKAQKIYEENLEEEDLLEEVKDELGYLIEPEYTYTKILDNANDGSFQLNQLGDAFNKLESQGSSFEGLFDDYDLYSKRLGQNLQKQTDTIAGVIKAIGKLELVKTPGDTLGDAYEYLISQFASESGKKAGEFYTPQEVSELLARLTLVGKDYSSGMSVYDPAMGSGSLLLNFRKYVPNSSRITYYGQEINTSTFNLARMNMILHHVDLANQKLRNGDTLDEDWPAEETTNFDSVVMNPPYSLKWNADKGFLDDPRFSKYGVLPPKSKADYAFLLHGFYHLKHSGAMAIVLPHGILFRGAAEGKIRQKLLEEGAIDAVIGLPANLFYSTGIPTTIVVLKKDKQDRSVLFIDASKEFEKVKTQNKLRQEDIDKILKTYEERPVDVEKYAHLASFDEIKENDFNLNIPRYVDTFEPEPEIDLRDVAKELRDIDQQINENEKELVGMLKELTSSDDDIMAGLQSIIEDFEEEIR

SEQ ID NO: 173 - DNA, 498 bp, Lactobacillus delbrueckii
ttgccggagtgattaaggcgatcggcaaattagaactggttaagactcctggtgacaccttgggggatgcttacgaatacttgatcagtcaatttgcctcaaaatcaggtaagaaggccggtgaattctatactccacaagaagtttctgaacttttagcacggttgactttagtcggtaaggattactcttctgggatgagcgtttacgacccggctatgggatcaggttcactgctgctgaactttagaaagtatgttccaaactcatcaagaattacttattacgggcaggaaatcaacacatcaacctttaacttggctagaatgaacatgattttgcaccacgttgatctggcaaaccagaagttgagaaacggggatacgttagacgaggactggcccgctgaagaaactaccaatttcgactcagttgtaatgaacccgccatattcacttaaatggagcgcagacaagggcttcttggatgacccacgtt

SEQ ID NO: 174 - protein, 165 aa, Lactobacillus delbrueckii
AGVIKAIGKLELVKTPGDTLGDAYEYLISQFASKSGKKAGEFYTPQEVSELLARLTLVGKDYSSGMSVYDPAMGSGSLLLNFRKYVPNSSRITYYGQEINTSTFNLARMNMILHHVDLANQKLRNGDTLDEDWPAEETTNFDSVVMNPPYSLKWSADKGFLDDPR

SEQ ID NO: 175 - DNA, 1599 bp, Lactobacillus delbrueckii
atggcagaagaaaattcaacagttagcttgcagagtggtttgtttgcagctgcagacgtcttgcgttcaaagatggacgccaatgagtataagaactatcttttggggactgttttctataagtacctttcagaccagcagctttacaagttggctgaagacgccggtgaagatgacgttactttagacgaagctcagaaaatctatgaggaaaatcttgaagaagaaggcctcctagatgaggttaaagacgagcttggatatttgatcgaaccggagtacacatacaccaagatcttagataatgccaacgatggcagtttccaactcaatcagttaggggatgcctttaacaagctagaaagtcaaggcagcagttttgaaggcctgtttgacgactatgacctgtattcaaagcggctgggtcaaaacttgcagaagcagacagatacaattgccggagtgattaaggcgatcggcaaattagaactggttaagactcctggtgacaccttgggggatgcttacgaatacttgatcagtcaatttgcctcagaatcaggtaagaaggccggtgaattctatactccacaagaagtttctgaacttttagcacggttgactttagtcggtaaggattactcttctgggatgagcgtttacgacccggcgatgggatcaggttcactgctgctgaactttagaaagtatgttccaaactcatcaagaattacttattacgggcaggaaatcaacacgtcaacctttaacttggctagaatgaacatgattttgcaccacgttgatctggcaaaccagaagttgagaaacggggatacgttagacgaggactggcccgctgaagaaactaccaatttcgactcagttgtaatgaacccgccatattcacttaaatggagcgcggacaagggcttcttggatgacccacgtttctctaagtatggtgttttgccgccaaagtctaaggcggactatgctttcttgcttcacggcttctaccacttgaaacacagtggggcaatggctatcgttctgccacacgggattcttttccgtggtgcagcggaaggaaagatccggcaaaagttgcttgaagagggcgcgattgatgcagtaatcggtttgcctgcaaacttgttctactcaactggtatcccaactactattgtcgttcttaagaaggacaagcaggatcggaacgtgctgtttattgacgcatctaaggagttcgagaaagttaagactcagaacaagctgcggcaagaagacattgataagatcttgaagacctacgaagagcggccagcagatgttgagaagtatgcccacttggcaagttttgacgaaatcaaagaaaatgacttcaacttgaacatttctcgttacgttgacacttttgagccagaaccagaaattgatctgcgagacgtggctaaggaactacgggatattgaccaacagatcaatgaaaacgagaaagaattggtagggatgcttaaggaattgacttcaagtgacgatgatatcatggcaggtttgcagagcatcatcgagaattttgaggaggaaatccgctaa

SEQ ID NO: 176 - protein, 532 aa, Lactobacillus delbrueckii
MAEENSTVSLQSGLFAAADVLRSKMDANEYKNYLLGTVFYKYLSDQQLYKLAEDAGEDDVTLDEAQKIYEENLEEEGLLDEVKDELGYLIEPEYTYTKILDNANDGSFQLNQLGDAFNKLESQGSSFEGLFDDYDLYSKRLGQNLQKQTDTIAGVIKAIGKLELVKTPGDTLGDAYEYLISQFASESGKKAGEFYTPQEVSELLARLTLVGKDYSSGMSVYDPAMGSGSLLLNFRKYVPNSSRITYYGQEINTSTFNLARMNMILHHVDLANQKLRNGDTLDEDWPAEETTNFDSVVMNPPYSLKWSADKGFLDDPRFSKYGVLPPKSKADYAFLLHGFYHLKHSGAMAIVLPHGILFRGAAEGKIRQKLLEEGAIDAVIGLPANLFYSTGIPTTIVVLKKDKQDRNVLFIDASKEFEKVKTQNKLRQEDIDKILKTYEERPADVEKYAHLASFDEIKENDFNLNISRYVDTFEPEPEIDLRDVAKELRDIDQQINENEKELVGMLKELTSSDDDIMAGLQSIIENFEEEIR

SEQ ID NO: 177 - DNA, 1599 bp, Lactobacillus delbrueckii
atggcagaagaaaattcaacagttagcttgcagagtggtttgtttgcggctgcagacgtcttgcgttcaaagatggacgccaatgagtataagaactatcttttggggactgttttctataagtacctttcagaccagcagctttacaagttggctgaagacgccggtgaagatgacgttactttagacaaggctcagaaaatctatgaggaaaaccttgaagaagaagacctactggaagaggttaaagacgagcttggatatttgatcgagccggaatacacctacaccaagatcttagataatgccaacgatggcagtttccaactcaatcagttaggggatgcctttaacaagctagaaagtcaaggcagcagttttgaaggcttgtttgacgactatgacctgtattcaaagcggctgggtcaaaacttgcagaagcagacagatacaattgccggagtgattaaggcgatcggcaaattagaactggttaagactcctggtgacaccttgggggatgcttacgaatacttgatcagtcaatttgcctcagaatcaggtaagaaggccggtgagttctatactccgcaagaagtgtcggaacttttggcacggttgactttagtcggtaaggattactcttctgggatgagcgtttacgacccggctatggggtcaggttcactgctgctgaactttagaaagtatgttccaaactcatcaagaattacttattacgggcaggaaatcaacacatcaacctttaacttggctagaatgaacatgattttgcaccacgttgatctggcaaaccagaagttgagaaacggggatacgttagacgaggactggccagctgaagaaaccactaacttcgactcagttgtcatgaacccgccatattcacttaaatggagcgcggacaagggcttcttggatgacccacgtttttctaaatacggtgttttgccgccaaagtctaaggcggactatgctttcttgcttcacggcttctaccacttgaagcatagtggggcaatggctatcgttctgccacacgggattcttttccgtggtgcagcggaaggaaagatccggcaaaagttgcttgaagagggcgcgattgatgcagtaatcggtttgcctgcaaacttgttctactcaactggtatcccaactactattgtcgttcttaagaaggacaagcaggatcggagcgtgctgtttattgacgcatctaaggagttcgagaaagttaagactcagaacaagctgcggcaagaagacattgataagatcttgaagacctacgaagagcggccagcagatgttgagaagtatgcccacttggcaagttttgacgaaatcaaagaaaatgacttcaatttgaacattcctcgttacgttgatacttttgagccagaaccagaaattgatctgcgggacgtggctaaggagctgcgggatattgaccaacagatcaatgaaaatgagaaagaattggtagggatgcttaaggaattgacttcaagtgacgatgatatcatggcaggtttgcagagcatcatcgaaaattttgaggaggaaatccgctaa

SEQ ID NO: 178 - protein, 532 aa, Lactobacillus delbrueckii
MAEENSTVSLQSGLFAAADVLRSKMDANEYKNYLLGTVFYKYLSDQQLYKLAEDAGEDDVTLDKAQKIYEENLEEEDLLEEVKDELGYLIEPEYTYTKILDNANDGSFQLNQLGDAFNKLESQGSSFEGLFDDYDLYSKRLGQNLQKQTDTIAGVIKAIGKLELVKTPGDTLGDAYEYLISQFASESGKKAGEFYTPQEVSELLARLTLVGKDYSSGMSVYDPAMGSGSLLLNFRKYVPNSSRITYYGQEINTSTFNLARMNMILHHVDLANQKLRNGDTLDEDWPAEETTNFDSVVMNPPYSLKWSADKGFLDDPRFSKYGVLPPKSKADYAFLLHGFYHLKHSGAMAIVLPHGILFRGAAEGKIRQKLLEEGAIDAVIGLPANLFYSTGIPTTIVVLKKDKQDRSVLFIDASKEFEKVKTQNKLRQEDIDKILKTYEERPADVEKYAHLASFDEIKENDFNLNIPRYVDTFEPEPEIDLRDVAKELRDIDQQINENEKELVGMLKELTSSDDDIMAGLQSIIENFEEEIR

SEQ ID NO: 179 - DNA, 1599 bp, Lactobacillus delbrueckii
atggcagaagaaaattcaacagttagcttgcagagtggcttatttgcggctgcagatgttttgcgttcaaagatggacgccaatgagtataagaagtatattttaggaattgttttctacaaatacctttctgaccagcagctgtacaaacttgctgaagacgcgggtaaagatgatgtcactttagacgtagctcaagagacttatgaagataacctggaagaaggagatcttttagaagaagttaaaagcgagctcggctatatgatcgggccggaatatacttataccaagatcttagcaaatgctaataatggcagcttccaacttaatcaattgaaggacgcttttacccagttagaaagtcaaggtaacagctttgaaggtttgttcgaagacttcgatctttattcaaggcaactgggccaaaatctacagaagcaaactgatactattgttggagtaatcaaggcaattggtaagttagaattagtaaatacgccgggggacaccttgggggatgcttacgaatacttgatcagtcaatttgcctcagaatcaggtaagaaggccggtgagttctatactccgcaagaagtgtcggaacttttggcacggttgactttagtaggtaaggattactcaaatgggatgacagtttacgacccagcgatggggtcaggctcattgctgctgaactttaaaaagtacgtaccaaactcatcgagaatcacctactatgggcaggaaatcaacacgtcaactttcaatttagctagaatgaacatgattttgcaccgtgtagacctggcaaaccaaaagttgagaaacggtgatacattagacgaagactggcctgctgaagaaattactaactttgattcagttgttatgaatccaccttactcacaaaagtggaaggcggacaaaggctttttagatgaccctcgtttctcaaagtatggtgttttacctccaaagtctaaggcggactatgctttcttgcttcatggtttctatcacttaaagcacagcggggcaatggctatcgttttgccacacgggattcttttccgtggtgcagctgaaggaaagatccggcaaaagttgcttgaagagggtgcaatcgatgctgtaattggtctaccagcaaacttattccactcaactagcatcccgaccactattgtcgttcttaagaaggacaagcaggatcggagcgtgctgtttattgatgcgtctaaggagtttgagaaagttaagactcagaataagctgcggcaagaagacattgataagattttaaagacctacgaagaacggccggcagatgtcgaaaagtatgctcacttggcaagttttgacgaaatcaaagaaaatgactttaacttgaacattcctcgttacgttgatacttttgagccagaaccagaaattgatctgcgggacgtggctaaggagctgcgggatattgatcaacagatcaatgaaaacgagaaagaattggtagggatgcttaaggaattgacttcaagtgacgatgatatcatggcaggtttgcagagcatcatcgaagattttgaggaggaaatccgctaa

SEQ ID NO: 180 - protein, 532 aa, Lactobacillus delbrueckii
MAEENSTVSLQSGLFAAADVLRSKMDANEYKKYILGIVFYKYLSDQQLYKLAEDAGKDDVTLDVAQETYEDNLEEGDLLEEVKSELGYMIGPEYTYTKILANANNGSFQLNQLKDAFTQLESQGNSFEGLFEDFDLYSRQLGQNLQKQTDTIVGVIKAIGKLELVNTPGDTLGDAYEYLISQFASESGKKAGEFYTPQEVSELLARLTLVGKDYSNGMTVYDPAMGSGSLLLNFKKYVPNSSRITYYGQEINTSTFNLARMNMILHRVDLANQKLRNGDTLDEDWPAEEITNFDSVVMNPPYSQKWKADKGFLDDPRFSKYGVLPPKSKADYAFLLHGFYHLKHSGAMAIVLPHGILFRGAAEGKIRQKLLEEGAIDAVIGLPANLFHSTSIPTTIVVLKKDKQDRSVLFIDASKEFEKVKTQNKLRQEDIDKILKTYEERPADVEKYAHLASFDEIKENDFNLNIPRYVDTFEPEPEIDLRDVAKELRDIDQQINENEKELVGMLKELTSSDDDIMAGLQSIIEDFEEEIR

SEQ ID NO: 181 - DNA, 1476 bp, Lactobacillus delbrueckii
atggcaacagctaatacacaatttgttaagagaattcagaatattatgcgccaggattcaggcattaatggagatgctcagcggattgaacaaatttcctggatgttatttttaaaggtttacgatgaccgggaaaaggtctgggaattaactaatgatgactacgagtcaattattccagcagggatgcactggcgggagtgggcaaccgataataaagatggtaaggcccttactggtgatgaattgcttgattttgttaacaacaaacttcttccagctcttaagaatattacagtaaccaaagataccccaattagcaaggcgattgtaaaagatgcgtttattgacgccaacaattatatgaagaatggtgtcttacttagacaagttgttaatgtaattgatgagcaagactttactgatcctgaagatcgtcatatgtttaatgacatttatgaagggatacttaaacagttgcagagtgcgggtaattctggtgaattctatactcctcgtgcactaacggattttattgctgagactttgaagccaaagctaggcgaaaaaatggcagacttagcttgtgggacaggtggctttttaactagtactcttaatcttttgaaaccacagattaaaactgtagaggatcagaagaaatataatgaggctgtttttgggattgagaaaaaggggcagccgtatattctagcggtaaccaatctattactacatgatgtggacaatcctgatattatccatggcaattcgttagagaagaatattacggaatacactgaaaaagaaaagttcgatattatcatgatgaatccaccatttggtggtgccgaattggacacaataaagaagaattttccgactgatttgcaaagcagcgaaacggccgatttattcatggacttaatcatgtaccgcttgaaagataatggtcgtgtaggtgtaattctcccagaaggctttatgtttagtacagatggtgctaagagaaatataaaacagaagttatttaatgattttaacgtacacactattattcgattacctaccacgattttttcaccatacacaacagttgctaccaatattattttcttcgagaagactcataaaacacaaaaaacgtggttctaccgattggatatgccagatggctataagcacttttctaagactcgtccgatgaaattagagcattttgatccggttagagaatggtggaataatcgtcatgagattcaggatgaagatggaaattataagtctaaagcgtattctctagaagaaatttctaaaaatgattatgatttagatctttgtggttttccaactgaaacagaagaaatattgcctccagatgaactaatggttaagtacaagtcagaacgtgaacatttaaatgctcaaattgataaaactttgagtacaatcaaagcattgttggcggaggattaa

SEQ ID NO: 182 - protein, 491 aa, Lactobacillus delbrueckii
MATANTQFVKRIQNIMRQDSGINGDAQRIEQISWMLFLKVYDDREKVWELTNDDYESIIPAGMHWREWATDNKDGKALTGDELLDFVNNKLLPALKNITVTKDTPISKAIVKDAFIDANNYMKNGVLLRQVVNVIDEQDFTDPEDRHMFNDIYEGILKQLQSAGNSGEFYTPRALTDFIAETLKPKLGEKMADLACGTGGFLTSTLNLLKPQIKTVEDQKKYNEAVFGIEKKGQPYILAVTNLLLHDVDNPDIIHGNSLEKNITEYTEKEKFDIIMMNPPFGGAELDTIKKNFPTDLQSSETADLFMDLIMYRLKDNGRVGVILPEGFMFSTDGAKRNIKQKLFNDFNVHTIIRLPTTIFSPYTTVATNIIFFEKTHKTQKTWFYRLDMPDGYKHFSKTRPMKLEHFDPVREWWNNRHEIQDEDGNYKSKAYSLEEISKNDYDLDLCGFPTETEEILPPDELMVKYKSEREHLNAQIDKTLSTIKALLAED

SEQ ID NO: 183 - DNA, 1599 bp, Lactobacillus delbrueckii
atggtagaagaaaattcaacagttagcttgcagagtggtttatttgcggctgcagatgtcttgcgttcaaagatggacgccaatgagtataagaactatcttttagggactgttttctataagtacctttcagaccaacagctttataagttggctgaagatgctggtgaagatgatattactttagacgaagctcagaagatctatgaggaaagtcttgaagaagaagacctcttggaagaagttaaggatgagcttggctacttgatcgaaccggagtacacatacaccaagatcttgaataatgccaacgatggcagtttccaactcaatcagttaggggatgcttttaacaagttggaaagtcaaggcagcagttttgaaggcttatttgatgactatgacttgtattcaaaacggctggggcaaaacttgcaaaagcagacagacacaattgccggagtgcttaaggcgatcgggaaattagaactggttaagactcctggtgacaccttgggggatgcttacgaatacttgatcagtcaatttgcctcagaatcaggtaagaaggccggtgaattctatactccacaagaaatatcagagcttttggcacggttgactttagtcggtaaggattactcttctgggatgagcgtttacgacccggcgatgggatcaggttcactgctgctgaactttagaaagtatgttccaaactcatcaagaattacttattacgggcaggaaatcaacacatcaacctttaacttggctagaatgaacatgattttgcaccacgttgatctggcaaaccagaagttgagaaacggggatacgttagacgaggactggccagctgaagaaaccactaacttcgactcagttgtcatgaacccgccatattcacttaaatggagtgcggacaagggcttcttggatgacccacgtttttctaaatacggtgttttgccgccaaagtctaaggcggactatgctttcttgcttcacggcttctaccacttgaagcatagtggggcaatggcaatcgttctgccgcacgggattcttttccgtggcgcggcggaaggaaagatccggcaaaagttgcttgaagagggcgcgattgatgcagtaatcggtttgcctgcaaacttgttctactcaactggcatcccgaccactattgtcgttctcaagaaggacaagcaggaccggagcgtgctatttattgacgcatctaaggagttcgagaaagttaagactcagaacaagctgcggcaagaagacattgataagatcttgaagacctacgaagagcggccagcagatgttgagaagtatgcccacttagcaagttttgacgaaatcaaagaaaatgacttcaacttgaacattcctcgttacgttgacacttttgagccagaaccagaaatcgatctgcgagacgtggctaaggaactacgggatattgaccaacagatcaatgaaaacgagaaagaattggtagggatgcttaaggaattgacttcaagtgacgatgatatcatggcaggattgcagagcatcatcgaagattttgaggaggaaatccgctaa

SEQ ID NO: 184 - protein, 532 aa, Lactobacillus delbrueckii
MVEENSTVSLQSGLFAAADVLRSKMDANEYKNYLLGTVFYKYLSDQQLYKLAEDAGEDDITLDEAQKIYEESLEEEDLLEEVKDELGYLIEPEYTYTKILNNANDGSFQLNQLGDAFNKLESQGSSFEGLFDDYDLYSKRLGQNLQKQTDTIAGVLKAIGKLELVKTPGDTLGDAYEYLISQFASESGKKAGEFYTPQEISELLARLTLVGKDYSSGMSVYDPAMGSGSLLLNFRKYVPNSSRITYYGQEINTSTFNLARMNMILHHVDLANQKLRNGDTLDEDWPAEETTNFDSVVMNPPYSLKWSADKGFLDDPRFSKYGVLPPKSKADYAFLLHGFYHLKHSGAMAIVLPHGILFRGAAEGKIRQKLLEEGAIDAVIGLPANLFYSTGIPTTIVVLKKDKQDRSVLFIDASKEFEKVKTQNKLRQEDIDKILKTYEERPADVEKYAHLASFDEIKENDFNLNIPRYVDTFEPEPEIDLRDVAKELRDIDQQINENEKELVGMLKELTSSDDDIMAGLQSIIEDFEEEIR

SEQ ID NO: 185 - DNA, 1608 bp, Lactobacillus farciminis
atgagtgaagatacatcaaaaacattagagcaagcattgtggaattccgccaacgccttgagaggaacgatggatgctagtgaatataaaaactatttgttaggtttgattttttatcgattcctaagtgatatgactttgaaaacagttatggaagctactggtgaagatggtgatccaatcgaagtctataagaaatattgggatgagcaacaagaagatattaagagtgaattatatggagctaacggatatatcattgaacctaatgatttatttgactcgatggtcgttagaattcaacatcatcaattccaaattagtgatttgaaacaagcattattcaatgttgaacaatcagtaaaagggcacagttcggaagaagatttcgaaggattattttctgatattgatttagattcaaataaattaggcaaaaatcccagtcaaactatgaacgacgttattacttctttaaaagatattaattttgataatggtcgcgatgttttaggggatgcctatgaatatttaattagtgagttcgctttgagtgctggtaaaaaggctggagaattctacacaccaagatcagttagtgaaattattgctcggattgtttctattggtcacaaagaaggagatactcaaattcgtagtgtctatgatccagctatgggttcaggttctttgctattaacgattgctgatcaagtaactggagatcaaccaattagttatcatggacaagaattgaacaatacaacttttaacttagctcgtatgaatttgatgttgcacggtgtaagttacgaagatatttatgctcgtaatggtgacactttggacgttgattggccatcagatgaaccttatcaattcgatgctgtagcgatgaatcctccttattcagcccattgggataataacgctggtcgtttgagtgacccacgttttcgtgattatggaaaattagcacctaaaactaaagccgactatgcctttctattgcatggtttatatcatttgaaaccgactggtacgatgggaattgtcttaccacatggtgtcttattccgtggtgcagctgaaggaacgattcgtaaagagttgattaataagaaccaaattgacgctgttatcgggcttccagctaacatcttttattcaacaagtattccaaccttaattatgattctcaaaaagaacaaaactaatgatgatatcttattcattgatgcaagtaatgaatttgaaaaaggtaaaaatcagaataaattaactgaagaaaatatcgataaaattgttcaaacttatgcagaccgtaagaacgttgataagtacgctcatgtagcgacaatcgatgagattaaagagaatgaatacaatttaaatattcctcgatatgttgatacttttgaacctgaaccagaaattgacttaggtgaagttactaaagaaattcgagaaaataacaaaaaaattatggaaaataaaaatgagttgctttcaatgatgaaagaactcacttcttcggatgaaaagactcagaatgatcttaatgattttatctctatgttgaatgatgaggtgaataatcatggataa

SEQ ID NO: 186 - protein, 535 aa, Lactobacillus farciminis
MSEDTSKTLEQALWNSANALRGTMDASEYKNYLLGLIFYRFLSDMTLKTVMEATGEDGDPIEVYKKYWDEQQEDIKSELYGANGYIIEPNDLFDSMVVRIQHHQFQISDLKQALFNVEQSVKGHSSEEDFEGLFSDIDLDSNKLGKNPSQTMNDVITSLKDINFDNGRDVLGDAYEYLISEFALSAGKKAGEFYTPRSVSEIIARIVSIGHKEGDTQIRSVYDPAMGSGSLLLTIADQVTGDQPISYHGQELNNTTFNLARMNLMLHGVSYEDIYARNGDTLDVDWPSDEPYQFDAVAMNPPYSAHWDNNAGRLSDPRFRDYGKLAPKTKADYAFLLHGLYHLKPTGTMGIVLPHGVLFRGAAEGTIRKELINKNQIDAVIGLPANIFYSTSIPTLIMILKKNKTNDDILFIDASNEFEKGKNQNKLTEENIDKIVQTYADRKNVDKYAHVATIDEIKENEYNLNIPRYVDTFEPEPEIDLGEVTKEIRENNKKIMENKNELLSMMKELTSSDEKTQNDLNDFISMLNDEVNNHG

SEQ ID NO: 187 - DNA, 1374 bp, Lactobacillus fermentum
atggattattcacaatcagttgaaacagcgaaaagagctatcttgagtattagcagtcaataccgggacctatttgacgctaattcgattgtaacaactttatttgatctcatttatttatacgaaataaatccagcgtatgctcaactccttaagcagaagggtatgcatattgaggcacttaacaagcagctacatgctattgctaaatctgatgaaactcaattggcagtaattgaagatcttaatgaaagcattcaacggatattgttgctaagaatcggtaaggacaagcaactgcaagtctttaatgaaatttgtgaaagcacattacgtttagttagacaacaatctgatcgctttgtattacttaaagccatgcaagctgcatacgttgaccttgaatcaaggctaaatgggagaactaatacgcctgatcagattaatgttctgatggctcagttagcaaatctatcttttgacggggacgaaccagttagaatatatgattctacttctggatggggcggctctttacttgaaatgagacgtgttataccaaattcacggaaagttagattgttaggacaagagttaaatgccaaagcatatcttttctgtgaaatggtgctaggcctattagacgatgacaatacaagtcatgcactgaataatggtgatgcacttgttgccgattggccatttggtgattcaggtgccgacgttattattaatgatccaccttactcaatgaggtggaatccagacccaaaccttcttgagaggggtatttatcataaaattggagtattaccaccaaaatctagagcagacttcgcctttgtactgcatggactggcccatttaaatgacaatggaacaatggtgattcagttaccgcatggtgttctattcagaggatcagcagaagcaaaaattcgtcagtacttgcttgaacgaaactatattgaagcagtgattggtttgccagctaatttacaaagcacaactgcaatcccaactatgattttagtattacggaagaatcgaaaacgcaaagacgtattgttcattgatgcaagtgatgatgaggttaaaaaagcacgttcacgtgatttgttgtcaacttcagcagttaacaagattgttgagacatatcacaaattcgttagcattcagcgatatgcgtatgtagctacaccgaaagagatcattgaaaatgattataatttaaacattccacgctacgtagatacttatatcccgcctaagctaatttctgtgtctgagttggaaaataaaatagtaaagatcgatcagcaattatcaaccctagaagctgatagccgacttattatgatgaagtatcagtag

SEQ ID NO: 188 - protein, 457 aa, Lactobacillus fermentum
MDYSQSVETAKRAILSISSQYRDLFDANSIVTTLFDLIYLYEINPAYAQLLKQKGMHIEALNKQLHAIAKSDETQLAVIEDLNESIQRILLLRIGKDKQLQVFNEICESTLRLVRQQSDRFVLLKAMQAAYVDLESRLNGRTNTPDQINVLMAQLANLSFDGDEPVRIYDSTSGWGGSLLEMRRVIPNSRKVRLLGQELNAKAYLFCEMVLGLLDDDNTSHALNNGDALVADWPFGDSGADVIINDPPYSMRWNPDPNLLERGIYHKIGVLPPKSRADFAFVLHGLAHLNDNGTMVIQLPHGVLFRGSAEAKIRQYLLERNYIEAVIGLPANLQSTTAIPTMILVLRKNRKRKDVLFIDASDDEVKKARSRDLLSTSAVNKIVETYHKFVSIQRYAYVATPKEIIENDYNLNIPRYVDTYIPPKLISVSELENKIVKIDQQLSTLEADSRLIMMKYQ

SEQ ID NO: 189 - DNA, 1374 bp, Lactobacillus fermentum; identical to SEQ ID NO: 187

SEQ ID NO: 190 - protein, 457 aa, Lactobacillus fermentum; identical to SEQ ID NO: 188

SEQ ID NO: 191 - DNA, 1515 bp, Lactobacillus gasseri
atgatcgctggagaattaaaaagcaaaattgataatctttgggaaacttttgcaaccggtggattaactaatccattgaacgtaattgaacaaattacatatttaatgttcattaaggatttagatgattcagacaatagaagaagaaaagataatgcatttctaggattgaatgactataaatctatttttgatggcgaagttcagattgatgatgatgtagtcgtagatggcgatgaacttagatggtctacttttaaagactttgcaccagaaaagatgtttaccgtagtacaaacagaagtttttccttttattaaaaacttgaaaaatggtgaagatagttcttttgctcgacatatgaaagatgcaacatttttaataccaacaccagggttgttatctaaagttgtagaatcgttggatgaaatttatcgcttgatggatgcagatgtttcaaagagagctgatattcgtggggacgtttatgaatatctcttaggaaagttatctactgctgggcgaaatggtcaattcagaacaccacgtcatattattaagatgatggttgaattaatgaatccacaagctaatgatagtatttgcgatccagccgctggtacggcaggctttttagtagaagctgctgagtatctgcaaactaaaaaaagtgctgaaatttatgatagtaaagaaagtaaagattattttcataatcaattgtttactggttatgatacagatccaacaatgcttcgtattggtgcgatgaacatgttaacgcatggagtagataatcctaaaattgaatatcaagatagtttatctgatcaaaataatgatagagataaatattctttgattatggctaatcctccatttaagggaagtttagactatgattcagtttcagatgatttgcttaaaacttgtaaaacaaagaaaacagaattattgtttttaaccttatttttaaaaatgcttagagtaggtggtagatgtgcatgtattgttccagatggagttttattcggttcatctaaagctcataaatcaattagaaaagtattggttgaagataataatttagaagcagtaatttcaatgccttcaggagtatttaaaccatacgctggagtttcaactgcaattttgatatttactaagactggtaatggcggaactgataaggtttggttctatgatatgaccgctgatggcttttcacttgatgacaaacgaacacctgttaaagaaaatgatattcctgatattattgaacgatttaagcatttagacaaagaaattgatcgtaaaaagactgaaaagtcatttatggttggtaagaaagatattgttgctaatgattatgatctttcaattaatcgttacaaagaaatagagtataaaccagttgaatatccgccaactaaggatattattgctgaaattgaaaaattagataaagaagcaaatgatgcattacaagagttaaaagctcttttaaaggactag

SEQ ID NO: 192 - protein, 504 aa, Lactobacillus gasseri
MIAGELKSKIDNLWETFATGGLTNPLNVIEQITYLMFIKDLDDSDNRRRKDNAFLGLNDYKSIFDGEVQIDDDVVVDGDELRWSTFKDFAPEKMFTVVQTEVFPFIKNLKNGEDSSFARHMKDATFLIPTPGLLSKVVESLDEIYRLMDADVSKRADIRGDVYEYLLGKLSTAGRNGQFRTPRHIIKMMVELMNPQANDSICDPAAGTAGFLVEAAEYLQTKKSAEIYDSKESKDYFHNQLFTGYDTDPTMLRIGAMNMLTHGVDNPKIEYQDSLSDQNNDRDKYSLIMANPPFKGSLDYDSVSDDLLKTCKTKKTELLFLTLFLKMLRVGGRCACIVPDGVLFGSSKAHKSIRKVLVEDNNLEAVISMPSGVFKPYAGVSTAILIFTKTGNGGTDKVWFYDMTADGFSLDDKRTPVKENDIPDIIERFKHLDKEIDRKKTEKSFMVGKKDIVANDYDLSINRYKEIEYKPVEYPPTKDIIAEIEKLDKEANDALQELKALLKD

SEQ ID NO: 193 - DNA, 1455 bp, Lactobacillus helveticus
atgaccaatcaagaaatagttcaaaaactttggaatgaatgtaatgtattacgtgacgatggtgtaagttatcaagactacattacggaattgacttatatcttgttcttgaagatgagtaaggaacaagacgaagaaaaagatattcctgaaaaatatcgttgggataacctagttaataaggaaggattagaattaaagaatttctatcgtcaactgcttctcgatttaggtaatccagaagtagttaagagtgagcgcattaatgcaatctatgctaatgcttctactgcgattgatgaaccagctaacctcgaaaagatcatcaaagatattaacgatcttgattggtggtcagctcgtgaagaaggccttggtgatctttatgaaggcttgatggaggaaaacgccaccgaagttaaatcaggtgctggtcaatactttactcctcgtgtcttgatcaacatgatggttaagatgactaagcctaagatcggtgatcgttgtaatgacccagcagctggtacttttggcttcatggttgcggctgatcaatatttaaaggataagactgatgattattctgaattatcagaagagaaatatgatttccaagttaaggaagctttttctggaatggaattggttcctaatacccaccgcttagccattatgaatgaatacttacatggcatggatggtcgacttgagcaaggtgattcactttcagctaatggtaagtggatgaagaacttcgatgttgtcttaaccaacccaccatttggtactaaaaagggtggcgaacgtgttactcgtgatgacttaacatacgagacttccaacaagcaacttaacttcttgcaaattatctataactcattgaagagggatggtaaggctagagctgctgtagttgttcctgataatgtcttatttgctgatggtgttggtgaagaaatcagaaaagatttgcttaacaagtgcaatttgcatactatcttgagattgcctactggtattttctatgctcaaggcgtacagactaatgtcttgttcttcactcgcggagaagaagataaggacaatactaaggaaacttggatttatgatatgcgccatcagatgcggtcatttggtaagcgcaatccgctgaatgataaagactttgtggaatttgaaaagttgttctgcgttgatgatcgttctaagcgcaaggagacttgggataaagaaaagaatccgaatggtcgctggcgcaagttcacaattgatgaaattaagaagcgtccgaatactagcttagatatttcatggatgagtgatgaagaagaacatgaaactaagtcattgaaggaaattcttagtgatatgaatgaaaagtctaaggcaattagtgaagcaattgcagagttgaataaggcattagaaggaattgacgatagtgaagacgaatag

SEQ ID NO: 194 - protein, 484 aa, Lactobacillus helveticus
MTNQEIVQKLWNECNVLRDDGVSYQDYITELTYILFLKMSKEQDEEKDIPEKYRWDNLVNKEGLELKNFYRQLLLDLGNPEVVKSERINAIYANASTAIDEPANLEKIIKDINDLDWWSAREEGLGDLYEGLMEENATEVKSGAGQYFTPRVLINMMVKMTKPKIGDRCNDPAAGTFGFMVAADQYLKDKTDDYSELSEEKYDFQVKEAFSGMELVPNTHRLAIMNEYLHGMDGRLEQGDSLSANGKWMKNFDVVLTNPPFGTKKGGERVTRDDLTYETSNKQLNFLQIIYNSLKRDGKARAAVVVPDNVLFADGVGEEIRKDLLNKCNLHTILRLPTGIFYAQGVQTNVLFFTRGEEDKDNTKETWIYDMRHQMRSFGKRNPLNDKDFVEFEKLFCVDDRSKRKETWDKEKNPNGRWRKFTIDEIKKRPNTSLDISWMSDEEEHETKSLKEILSDMNEKSKAISEAIAELNKALEGIDDSEDE

SEQ ID NO: 195 - DNA, 1656 bp, Lactobacillus helveticus
atgtcagaagaaaaagttttaactaaaaaagaattagagagtgctttatttagtgcagcagatgcattacgctctaaaatggatgctaatgaatataaaaattatttattaggtattatcttttataaatacctttctgataagatgctttatcatgtcggagaagtattagaaggtagacgcgatttatcattagaagagaatcaaaaaatatatgaagaaaagtttgatactgaagatcttcaggacgatataaaaacgactttttcatatactatttctccagaacatacttttacgtatattttgaatgaaattaatggaacggctagaactaaagatggcaaaattaaaacatttcaaatatcagatttagcagatgcgtttaatgatattgaaagcactaaagacagtgatttcgaaggcctatttgcggacgttcaactatattcacctcgattaggtacaaatgcacaaaagcaagctgatactattgcaaatgttataaaagcaataggcgatttagaattagttaaccaagttgataataaggatactttaggtgatgcttatgaatatttaattaagcaatttgcttctgaatctggtaaaaaagcgggcgaattctacactccgcaagaagtatctgaacttttaactaagttaactttagtagataaaaattatcctgaagaaatgacagtatatgatcctgcaatggggtccggttctttacttttaaaatttaaaaagtatattaaattggccaatggtcaagcggataaaatcttctattatggtcaagaaattaatatgtctacctataatcttgcaagaatgaacatgattttacatggtgtagattcttcaaaccaagaattaagacgtggagatactctagatgaagattggccacctgtttctaaaactatgtttgatgctgtggtaatgaatcctccatattcactaaaatggtcggctaataagggattcttacaagatccaagatttagtccatatggagtattacctcccaaatcaaaagctgattatgcatttctattgcatggtttctatcatttaaagaatacaggtactatggccattgttttacctcatggtgttttattccggggagcagcagaaggtaagattcgtaagaagctccttgaaaatggttcaattgatgcggtaattggattaccatctaacttgttctacagtactagtattccaactgttattgtggtgttgaagaaggataaaactgatagaagtgtaatgtttattgatgcttctaaaggatttgaaaagaaaaagaaccaaaatgagttaagagaagaagatattcaaaagattcttgatacttatgaaaagcgtgaggatgttgaacgatatgctcatttagctaagtttgatgaaattgaagaaaatgatttcaatcttaacataccaaggtatgtagataccttcgttcccgagccaccagtggatctgaagaaagttgctactgacctgcatgaaacaaatgttgaaattgaaaaaaatcaacgtgagttagttggtatgttaaaggaattaacttcagatgatactgaaattatggatggtttagatgccattataaaggaactggaggccgagcttcatgaataa

SEQ ID NO: 196 - protein, 551 aa, Lactobacillus helveticus
MSEEKVLTKKELESALFSAADALRSKMDANEYKNYLLGIIFYKYLSDKMLYHVGEVLEGRRDLSLEENQKIYEEKFDTEDLQDDIKTTFSYTISPEHTFTYILNEINGTARTKDGKIKTFQISDLADAFNDIESTKDSDFEGLFADVQLYSPRLGTNAQKQADTIANVIKAIGDLELVNQVDNKDTLGDAYEYLIKQFASESGKKAGEFYTPQEVSELLTKLTLVDKNYPEEMTVYDPAMGSGSLLLKFKKYIKLANGQADKIFYYGQEINMSTYNLARMNMILHGVDSSNQELRRGDTLDEDWPPVSKTMFDAVVMNPPYSLKWSANKGFLQDPRFSPYGVLPPKSKADYAFLLHGFYHLKNTGTMAIVLPHGVLFRGAAEGKIRKKLLENGSIDAVIGLPSNLFYSTSIPTVIVVLKKDKTDRSVMFIDASKGFEKKKNQNELREEDIQKILDTYEKREDVERYAHLAKFDEIEENDFNLNIPRYVDTFVPEPPVDLKKVATDLHETNVEIEKNQRELVGMLKELTSDDTEIMDGLDAIIKELEAELHE

SEQ ID NO: 197 - DNA, 1455 bp, Lactobacillus helveticus
atgaccaatcaagaaatagttcaaaaactttggaatgaatgtaatgtattacgtgacgatggtgtaagttatcaagactacattacggaattgacttatatcttgttcttgaagatgagtaaggaacaagacgaagaaaaagatattcctgaaaaatatcgttgggataacctagttaataaggaaggattagaattaaagaatttctatcgtcaactgcttctcgatttaggtaatccagaagtagttaagagtgagcgcattaatgcaatctatgctaatgcttctactgcgattgatgaaccagctaacctcgaaaagatcatcaaagatattaacgatcttgattggtggtcagctcgtgaagaaggccttggtgatctttatgaaggcttgatggagaaaaacgccaacgaagttaaatcaggtgctggtcaatactttactcctcgtgtcttgatcaacatgatggttaagatgactaagcctaagatcggtgatcgttgtaatgacccagcagctggtacttttggcttcatggttgcggctgatcaatatttaaaggataagactgatgattattctgaattatcagaagagaaatatgatttccaagttaaggaagctttttctggaatggaattggttcctaatacccaccgcttagccattatgaatgaatacttacatggcatggatggtcgacttgagcaaggtgattcactttcagctaatggtaagtggatgaagaacttcgatgttgtcttaaccaacccaccatttggtactaaaaagggtggcgaacgtgttactcgtgatgacttaacatacgagacttccaacaagcaacttaacttcttgcaaattatctataactcattgaagagggatggtaaggctagagctgctgtagttgttcctgataatgtcttatttgctgatggtgttggtgaagaaatcagaaaagatttgcttaacaagtgcaatttgcatactatcttgagattgcctactggtattttctatgctcaaggcgtacagactaatgtcttgttcttcactcgcggagaagaagataaggacaatactaaggaaacttggatttatgatatgcgccatcagatgcggtcatttggtaagcgcaatccgctgaatgataaagactttgtggaatttgaaaagttgttctgcgttgatgatcgttctaagcgcaaggagacttgggataaagaaaagaatccgaatggtcgctggcgcaagttcacaattgatgaaattaagaagcgtccgaatactagcttagatatttcatggatgagtgatgaagaagaacatgaaactaagtcattgaaggaaattcttagtgatatgaatgaaaagtctaaggcaattagtgaagcaattgcagagttgaataaggcattagaaggaattgacgatagtgaagacgaatag

SEQ ID NO: 198 - protein, 484 aa, Lactobacillus helveticus
MTNQEIVQKLWNECNVLRDDGVSYQDYITELTYILFLKMSKEQDEEKDIPEKYRWDNLVNKEGLELKNFYRQLLLDLGNPEVVKSERINAIYANASTAIDEPANLEKIIKDINDLDWWSAREEGLGDLYEGLMEKNANEVKSGAGQYFTPRVLINMMVKMTKPKIGDRCNDPAAGTFGFMVAADQYLKDKTDDYSELSEEKYDFQVKEAFSGMELVPNTHRLAIMNEYLHGMDGRLEQGDSLSANGKWMKNFDVVLTNPPFGTKKGGERVTRDDLTYETSNKQLNFLQIIYNSLKRDGKARAAVVVPDNVLFADGVGEEIRKDLLNKCNLHTILRLPTGIFYAQGVQTNVLFFTRGEEDKDNTKETWIYDMRHQMRSFGKRNPLNDKDFVEFEKLFCVDDRSKRKETWDKEKNPNGRWRKFTIDEIKKRPNTSLDISWMSDEEEHETKSLKEILSDMNEKSKAISEAIAELNKALEGIDDSEDE

SEQ ID NO: 199 - DNA, 1455 bp, Lactobacillus helveticus
atgaccaatcaagaaatagttcaaaaactttggagtgaatgtaatgtattacgcgacgatggtgtaagttatcaagactacattacggaattgacttatatcttgttcttgaagatgagtaaagaacaagacgaagaaaaagatattcctgaaaaatatcgttgggataacctaattaataaggaaggattagaattaaagaatttctatcgtcaactgcttcttgatttaggtaatccagaagtagttaagagtgagcgcattaatgcaatctatgctaatgcttctactgcgattgatgaaccagctaacctcgaaaagatcatcaaagatattaacgatcttgattggtggtcagctcgtgaagaaggccttggtgatctttatgaaggcttgatggagaaaaacgccaacgaagttaaatcaggtgctggtcaatactttactcctcgtgtcttgatcaacatgatggttaagatgacagagcctaagatcggtgatcgttgtaatgacccagcagctggtacttttggcttcatggttgcggctgatcaatatttaaaggatcagactgatgattattctgaattatcagaagagaaatatgatttccaagttaaggaagctttttctggaatggaattggttccgaatacgcaccgcttagccattatgaatgaatacttacatggcatggatggtcgacttgagcaaggtgattcactttcagctaatggtaagtggatgaagaacttcgatgttgtcttaaccaacccaccatttggtactaaaaagggtggcgaacgtgttactcgtgatgacttaacatacgagacttccaacaagcaacttaacttcttgcaaattatctataactcattgaagagggatggtaaggctagagctgctgtagttgttcctgataatgtcttatttgctgatggtgttggtgaagaaatcagaaaagatttgcttaacaagtgcaatttgcatactatcttgagattgcctactggtattttctatgctcaaggcgtacagactaatgtcttgttcttcactcgcggagaagaagataaggataatactaaggaaacttggatttatgatatgcgtcaccagatgcggtcatttggtaagcgtaatccgttgaatgataaagactttgcggaatttgaaaagttgttctgcgttgatgatcgttctaagcgcaaggagacttgggataaagaaaagaatccgaatggtcgctggcgcaagttcacgattgatgaaattaagaagcgtacgaatactagcttagatatttcatggatgagtgatgaagaagaacatgaaactaagtcattgaaggaaattcttagtgatatgaatgaaaagtctaaggcaattagtgaagcaattgcagagttgaataaggcattagaaggaattgacgatagtgaagacaaatag

SEQ ID NO: 200 - protein, 484 aa, Lactobacillus helveticus
MTNQEIVQKLWSECNVLRDDGVSYQDYITELTYILFLKMSKEQDEEKDIPEKYRWDNLINKEGLELKNFYRQLLLDLGNPEVVKSERINAIYANASTAIDEPANLEKIIKDINDLDWWSAREEGLGDLYEGLMEKNANEVKSGAGQYFTPRVLINMMVKMTEPKIGDRCNDPAAGTFGFMVAADQYLKDQTDDYSELSEEKYDFQVKEAFSGMELVPNTHRLAIMNEYLHGMDGRLEQGDSLSANGKWMKNFDVVLTNPPFGTKKGGERVTRDDLTYETSNKQLNFLQIIYNSLKRDGKARAAVVVPDNVLFADGVGEEIRKDLLNKCNLHTILRLPTGIFYAQGVQTNVLFFTRGEEDKDNTKETWIYDMRHQMRSFGKRNPLNDKDFAEFEKLFCVDDRSKRKETWDKEKNPNGRWRKFTIDEIKKRTNTSLDISWMSDEEEHETKSLKEILSDMNEKSKAISEAIAELNKALEGIDDSEDK

SEQ ID NO: 201 - DNA, 1560 bp, Lactobacillus kefiranofaciens
atgattaacggagaaattaaaaataaagttgatgctttgtgggatagttttgctgctggaggattgactaatcctttagaagttattgaacaaattacttacttaatgtttattcgtgagttagatgaagcagataatattcagcaaaaagaaaatatgatgttgggtttaccatacaccagtatttttgcgggagaaaagaatataggtggtcaaacaattgaaggtaaagaattaaaatggtcagtatttcatgatttacccgcagataagatgtttatcttaatgaatagatttgtattcccattcatcaaaaatctacatgatgataaagatagtgcgtattccaaatatatgacagatgcgatttttaaattgccaactccagaattattatcaaaagttgttgattcacttgatgatatttacaaaacaatggataaggttcgaaaaagtaatttagaaaaagctgacagtgagggtaatcttgctgaaaatatgtccagtgatgttcgtggtgatttatacgaatatttactaagtaaattgtcaactgcagggcggaatggtcaatttcgtacccctcgccatattatcaaaatgatggttgagttgatgaatccaactccagacgataaaattgctgaccctgcatgtggtacttctggattcttaatagccgctgcagagtatttgagagaagatccagaaaaagaaaaagcaatcttttataatccagagaataaaaaacgctatatgagtagtatgtttactggctatgatatggacaaaactatgctcagaatcggtgccatgaacatgatgacgcatgggattactgatcctcatattgattatcgtgatagtctttctgatcaaaatactgataaagacgaatattctttggttttagcaaacccaccttttaagggaagtctggattatgaaatggtatcagatgatctactgaaagtttgcaagaccaaaaagacagaattgctatttttagccttatttttaagaatgctaaaagttggtggtcgctgtgcatgtattgttccagatggtgttctttttggatcatcaagtgcacataaagccgttagaaaacaacttgtagatggaaaccgattagaagctgtaatttcaatgccttcaggtgtatttaaaccttacgctggtgtgtcaacagcagttttgatttttacaaagactaatcatggtggcaccgacaaggtatggttctatgatatgactgcggatggttattcacttgatgataaacgtacaaaagttgatgaaaatgatattccaggtatcattaagcgatttaagcgtctagataaagaagcagataggaaacgtacagataagtcatttttagttgataagaaggaaatagtcgataatgcgtatgacttatcaattaatcgctataaagaaattaaatatgttccagttaagtatccacctacagaggatattttggcagaaattatgaaattggatgcagaagcaactaaggatctccaagaattgaaagatatgtttggaaagtaa

SEQ ID NO: 202 - protein, 519 aa, Lactobacillus kefiranofaciens
MINGEIKNKVDALWDSFAAGGLTNPLEVIEQITYLMFIRELDEADNIQQKENMMLGLPYTSIFAGEKNIGGQTIEGKELKWSVFHDLPADKMFILMNRFVFPFIKNLHDDKDSAYSKYMTDAIFKLPTPELLSKVVDSLDDIYKTMDKVRKSNLEKADSEGNLAENMSSDVRGDLYEYLLSKLSTAGRNGQFRTPRHIIKMMVELMNPTPDDKIADPACGTSGFLIAAAEYLREDPEKEKAIFYNPENKKRYMSSMFTGYDMDKTMLRIGAMNMMTHGITDPHIDYRDSLSDQNTDKDEYSLVLANPPFKGSLDYEMVSDDLLKVCKTKKTELLFLALFLRMLKVGGRCACIVPDGVLFGSSSAHKAVRKQLVDGNRLEAVISMPSGVFKPYAGVSTAVLIFTKTNHGGTDKVWFYDMTADGYSLDDKRTKVDENDIPGIIKRFKRLDKEADRKRTDKSFLVDKKEIVDNAYDLSINRYKEIKYVPVKYPPTEDILAEIMKLDAEATKDLQELKDMFGK

SEQ ID NO: 203 - DNA, 1635 bp, Lactobacillus kefiranofaciens
atgacagaaattaagacgaaaaaagaacttgaaacagcactatatagtgcggcagatgctctgcgcggaaagatggacgctaatgaatataagaactatttattaggaattgtcttttacaaatatctttcggataagatgttgtactatgtaggagaattaattggtgatcctaatgcaaatttagaagaaaatcaaaaattatatgaagataattatgatgataaagaacttcaaaaggaattaaagcgaacttttacgtattcaattggtaggtatcatacgtttacgtatatattgaatgaaataattgaactggctagaaaagataataaaattaatacttttcagatttctgatttggctgatgcttttaatgatattgagagtactagtgataattttcgaggactatttgatgatgttgatctttattcacgtgtattgggtgataatgctcaacaacaagcagatactattgcaaatgtaatgaaagcaataggaaatttagaaattgtgaaaactagtagtgatactttaggcgatgcatatgaatatctgattagacagtttgcatctgaaactggaaaaaaatcaggtgaattttataccccacaaaaagtttccgaattattaacgaaactttctttattaggcaaagaatatccagatggcttagttgtatatgatccagcaatgggatcaggctctctattattgaactttggcaagtttatcaaaaattttggtggtaaaccggaacaggttatttattttggacaagaaattaatttctcaactcatagattagccaagatgaatatgattcttcatggcgtagattttggaaatcagcatttacgtcgaggtaatactttaagtgccgattggccacctatttctcgaactatgtttgatgcggtagttatgaacccaccatattcacttaaatggcctgcaaataaaggatttttgcaagatccaagatttagtccttacggtgtattaccacctaaatctaaggccgattatgcattcttacttcatggattttatcatttgaagaataccggtactatggcaattgttcttcctcatggcgttctattccgtggtgccgcggaaggaaagattcgtaaaaagttacttgaagatggttcaattgatgctgtaatcgggcttccagctaatttgttttacaacactagtattcctacagtaattcttgtattaaagaaggacaaggaagacagaagtgtgatgtttattgatgcatccaagggttttgaaaagaaaaagaatcagaatgaattaagagaggaagacattcagaagattcttgaaacttatgaaaagcgtgaggaagttaaacgttatgctcatttagctaaatatgatgaaatcgaagaaaatgatttcaatttaaatattcctcgttacgttgatacatttgttcctgagcctccagttgatttgaaaaaagttgcttctgatttgcatgaaacaaatgtagaaattgaaaagaatcagaaagaattagtaggaatgctgaaggaattaacttcagatgatcaggatgtaatgagtggattagatgcaattatcaaggaactagaaggagagttacatgactga

SEQ ID NO: 204 - protein, 544 aa, Lactobacillus kefiranofaciens
MTEIKTKKELETALYSAADALRGKMDANEYKNYLLGIVFYKYLSDKMLYYVGELIGDPNANLEENQKLYEDNYDDKELQKELKRTFTYSIGRYHTFTYILNEIIELARKDNKINTFQISDLADAFNDIESTSDNFRGLFDDVDLYSRVLGDNAQQQADTIANVMKAIGNLEIVKTSSDTLGDAYEYLIRQFASETGKKSGEFYTPQKVSELLTKLSLLGKEYPDGLVVYDPAMGSGSLLLNFGKFIKNFGGKPEQVIYFGQEINFSTHRLAKMNMILHGVDFGNQHLRRGNTLSADWPPISRTMFDAVVMNPPYSLKWPANKGFLQDPRFSPYGVLPPKSKADYAFLLHGFYHLKNTGTMAIVLPHGVLFRGAAEGKIRKKLLEDGSIDAVIGLPANLFYNTSIPTVILVLKKDKEDRSVMFIDASKGFEKKKNQNELREEDIQKILETYEKREEVKRYAHLAKYDEIEENDFNLNIPRYVDTFVPEPPVDLKKVASDLHETNVEIEKNQKELVGMLKELTSDDQDVMSGLDAIIKELEGELHD

SEQ ID NO: 205 - DNA, 687 bp, Lactobacillus phage
atgaagtcaccggcagcgctgcatgcgagtgaagctacaggaggtatagttatggcaaaattaggacgcgacgaattatatacaatagctggagttaatcagcatgcggaatttgaaaagtttataagcgatttgctgtttaaaccaaaagaacgcaatgatttttacagaaaaatcctagctattaatagtaacgtatctgttgatacgtttcgtgaatactttgaagaatatgctgcagagagaaaatctcagcagcaagattttacacctgattatgtttctggattactagcaaagattactaggaatgataatggtagtgaaagtggatggtctggatatgatccaactgccggaacgggatcactaattattaaaaaatggaatgatgacagattagcagagacgccattcagctatgccccacacaactatttgtatatggtggaggaatttggagataacgttattccatatttactacacaatattgcgattaggggtatgaattgtgttgtgattcatggcgacacattagagagaaatgtaaaacagatttattttgttcaaaattctcaggatgattacatgaaattctctgatataaacgttatgcctcacaccgataagttaaagaaaaatttaacgtatctaattggagtgaaaaagctattgaacatatag

SEQ ID NO: 206 - protein, 228 aa, Lactobacillus phage
MKSPAALHASEATGGIVMAKLGRDELYTIAGVNQHAEFEKFISDLLFKPKERNDFYRKILAINSNVSVDTFREYFEEYAAERKSQQQDFTPDYVSGLLAKITRNDNGSESGWSGYDPTAGTGSLIIKKWNDDRLAETPFSYAPHNYLYMVEEFGDNVIPYLLHNIAIRGMNCVVIHGDTLERNVKQIYFVQNSQDDYMKFSDINVMPHTDKLKKNLTYLIGVKKLLNI

SEQ ID NO: 207 - DNA, 1587 bp, Lactobacillus plantarum
atgagtcatattgaacaggccgaacaacaggctgaactacaaaaaagattatgggctgtggcaaatgatctgcgcggtaacatggatgccagtgagtatcgaaactatatcttaggattaatcttttatcgctttttgtctgaaaaagttgaaaattacgcaaatgagttacttcaagacgatgatgttgactttgcagatgcggaacaagatgctgacctgatgcaagatttgaaggatgaagtgattgacgtcttaggtttcttcattgaaccacgatatctgtttacaactatggtcaagaagattaacgctggcgattttgacgttgaaatgttacaaaatgccatcaacgaatctagaatttcgaccttaggcaaagagtcagaaaatgactttaaagggctattcgaagacttggatttgcagtcatcacggttaggaaacacagttgccaagcgtagtgaactgattgccaaagtgattctatccttgtcgaatattgattttggtgaacaagatattaaaattgatattttgggtgatgcctacgaatatttgattggtcaatttgccgcttcagctgggaaaaaggcgggcgaattttatacgccacaacaagtttctaagttattggcaagaattgttacggccggtaaagatcgtttgaagacggtttatgatcctacgatgggctccgggtcgctgttattacaattgggtaattacgcaacgattggaaactactatggtcaagaaatcaacggtacgacttacaacttggcgcggatgaacttgttgatgcatgaggttagttataatcggtttgatttacgtcaaggcgatactttagaggaagatcactttgatgatctaacttttgacgctgtcgttgccaacccaccttattcggctaaatggaatccagatgataaattagatgatgaacgttttcggaaatatgggaagacggcaccgaagtcgaaggcggattttgcgtttgttgaacacatgctctatcacttaaataatgaaggcacgatggcagttgtattaccacatggtgtcttattccgcggtgctgcggaaggaaaaatccgacagtacatgattgaacatgacaacgtcttagatgccgtcatcggattaccagcgaacttattctacggaactagtattccgaccgttgtattggtcttcaagaaggggcgcgaacgtcaggatatcttctttattgacgcgtctaatgattttgaaaagggtaagaaccaaaacaacttaacggacgaaaatgtcgataagattttggaaacccttgaaaaacgtgaagatgtggataagtatgctcatcgtgcagaagtagctgagattgtcgaaaacgagtataacttaaacattccgcgatacgtcgatacattcgaagaggaaccacctgttgatgtggataagttggtcaaggaaatgggcgaagcggatgccaagatcaatgacctacaatctgaattatccggaatgatggccgatttagtggcgactgaccctgtcgctcaacagcagcttgaggccattaagaggatgttacaatga

SEQ ID NO: 208 - protein, 528 aa, Lactobacillus plantarum
MSHIEQAEQQAELQKRLWAVANDLRGNMDASEYRNYILGLIFYRFLSEKVENYANELLQDDDVDFADAEQDADLMQDLKDEVIDVLGFFIEPRYLFTTMVKKINAGDFDVEMLQNAINESRISTLGKESENDFKGLFEDLDLQSSRLGNTVAKRSELIAKVILSLSNIDFGEQDIKIDILGDAYEYLIGQFAASAGKKAGEFYTPQQVSKLLARIVTAGKDRLKTVYDPTMGSGSLLLQLGNYATIGNYYGQEINGTTYNLARMNLLMHEVSYNRFDLRQGDTLEEDHFDDLTFDAVVANPPYSAKWNPDDKLDDERFRKYGKTAPKSKADFAFVEHMLYHLNNEGTMAVVLPHGVLFRGAAEGKIRQYMIEHDNVLDAVIGLPANLFYGTSIPTVVLVFKKGRERQDIFFIDASNDFEKGKNQNNLTDENVDKILETLEKREDVDKYAHRAEVAEIVENEYNLNIPRYVDTFEEEPPVDVDKLVKEMGEADAKINDLQSELSGMMADLVATDPVAQQQLEAIKRMLQ

SEQ ID NO: 209 - DNA, 1587 bp, Lactobacillus plantarum
atgagtcatattgaacaggccgaacaacaggctgaactacaaaaaagattatgggctgtggcaaatgatctgcgcggtaacatggatgccagtgagtatcgaaactatatcttaggattgatcttttatcgttttttgtccgaaaaagttgaaaactatgcaaatgagttacttcaagacgatgatgttgactttgcagatgcggaacaagatgccgatttgatgcaagatttgaaggatgaagtgattgacgtcttagggttcttcattgaaccacgatatctatttacgactatggtcaagaagattaacgctggtgattttgacgttgaaatgttacaaaatgccatcaacgaagtccagaattcgaccttaggcaaagagtcagaaaatgactttaaagggctattcgaagacttggatttgcagtcatcacggttaggaaatacagttgccaagcgtagtgaactgattgctaaagtgattttatccttgtcgaatattgattttggtgaacaagatattaaaatcgatattttgggtgatgcctatgaatatttgattggtcaatttgccgcttcggccgggaaaaaggcgggcgaattttatacgccacaacaggtttctaagttattggcaagaattgttacggccggtaaagatcgtttgaagacggtttatgatcctacgatgggctccgggtcgctgttattacaattgggtaattacgcaacgattggaaactactatggtcaagaaatcaacggtacgacttacaacttggcgcgaatgaacttgttgatgcatgaggttagttataatcggtttgatttacgtcaaggcgatactttagaggaagatcactttgatgatctaacttttgacgctgtcgttgccaatccaccttattcggctaagtggaatccagatgataaattagatgatgaacgttttcggaaatatgggaagacggcaccgaagtcgaaggcggattttgcgtttgttgaacacatgctctatcacttaaataatgaaggcacgatggcagttgtattaccacatggtgtcttattccgcggtgctgcggaaggaaaaatccgacagtacatgattgaacatgacaacgtcttagatgccgtcatcggattaccagcgaacttattctacggaactagtattccgaccgttgtattggtcttcaagaaggggcgcgaacgtcaggatatcttctttattgacgcgtctaatgattttgaaaagggtaagaaccaaaacaacttaacggacgaaaatgtcgataagattttggaaacccttgaaaaacgtgaagatgtggataagtatgctcatcgtgcagaagtagctgagattgtcgaaaacgagtataacttaaacattccgcgatacgtcgatacattcgaagaggaaccacctgttgatgtggataagttggttaaggaaatgggcgaagcggatgccaaaatcaacgacctacaatctgaattatccggaatgatggccgatttagtggcgactgaccctgtcgctcaacagcagcttgaggccattaagaggatgttacaatga

SEQ ID NO: 210 - protein, 528 aa, Lactobacillus plantarum
MSHIEQAEQQAELQKRLWAVANDLRGNMDASEYRNYILGLIFYRFLSEKVENYANELLQDDDVDFADAEQDADLMQDLKDEVIDVLGFFIEPRYLFTTMVKKINAGDFDVEMLQNAINEVQNSTLGKESENDFKGLFEDLDLQSSRLGNTVAKRSELIAKVILSLSNIDFGEQDIKIDILGDAYEYLIGQFAASAGKKAGEFYTPQQVSKLLARIVTAGKDRLKTVYDPTMGSGSLLLQLGNYATIGNYYGQEINGTTYNLARMNLLMHEVSYNRFDLRQGDTLEEDHFDDLTFDAVVANPPYSAKWNPDDKLDDERFRKYGKTAPKSKADFAFVEHMLYHLNNEGTMAVVLPHGVLFRGAAEGKIRQYMIEHDNVLDAVIGLPANLFYGTSIPTVVLVFKKGRERQDIFFIDASNDFEKGKNQNNLTDENVDKILETLEKREDVDKYAHRAEVAEIVENEYNLNIPRYVDTFEEEPPVDVDKLVKEMGEADAKINDLQSELSGMMADLVATDPVAQQQLEAIKRMLQ

SEQ ID NO: 211 - DNA, 1539 bp, Lactobacillus reuteri
gtgaaaatggcaaccaagtctaaggaattaagtattgaggacaaattatggaaaacagctgatgcgttgcgtggcagcatggacgcttcagaatatcgtaatgttgtactggggttaattttccttaagtatgtatcagattcatttgaaaccaggcataatgaattgttgaaatcagattatcctgaagatgctgaagatcctgatatgtatctttcggaaaatattttttgggtaccgaaagaagcacgttgggaattaattcaacaatcagcaaaaacacctcaaattggtgaaattattgacagtgcaatggatgcaattgaaaaaagcaatgattcattgcgtggggttttaagtaagaactatgcatctccagatcttgataaagctcgtctaggtgaagtggttgatttaatttcagatatcagtctaggtgataaacatgccaagcaatctgatattttgggtcgtgtatatgagtactttctcaatgaatttgcctctcaagaaggtaaaaagggtggtgaattttacacaccacgttccattgttcgtacgctagtagaaatgattgaaccgtacaaaggacgtatttatgacccatgttgcgggtctggtgggatgtttgtgcaatctgacaaattcgtccaagaacaccaaggtaaaatcggcgacctatcagtttatggtgaagagtctaacccaaccacttggaaattagcaaagatgaatcttgccattcgtggtattgataataaccttgggccacatcaaggtgatacttttactaatgacctgcacaaaggtgaaagatttgattttatcctagctaatccaccatttaatgtaaaaaattggaatggtgacaagttgcgtgaagatgctcgctggcaatatggagttccaccagttggtaatgccaactatgcctggattgaacatatcattagcaaattagcacctgatgggaaagccggattcgtgttagctaacggtgctttatcaacctctacaacggcagagcatgatattcgtaaagcaattcttgaagatgacaagattgatgcgatcgtcgccttaccggataaaatgttttattcaactggtatcccagtttcactttggttcgttgatatgaacaaggaatctgaaaatgaacgagatagaaaaggtgagactttatttatcgatgcgcgtgatcttggtgaaatgattgatcgaactcatcgggcattctcaaaggaagatattaaaaaagtagcagacacatatcatgcataccgtggtaccaatgatcaagagtataaggatgtccccggattttgtaaggtagccaaactagatgaaattgcaaagaatgattacgtattaacacctggtaggtacgttggcttagcaaaacaagaagacgatggtgaaccttatgaagttaagatggctcgtctgactggagaattgaaaaaacagtttgaggagagtaataagctccaagctgagatcaaagatgtattgaaggagcttggatatgaaatatag

SEQ ID NO: 212 - protein, 512 aa, Lactobacillus reuteri
MKMATKSKELSIEDKLWKTADALRGSMDASEYRNVVLGLIFLKYVSDSFETRHNELLKSDYPEDAEDPDMYLSENIFWVPKEARWELIQQSAKTPQIGEIIDSAMDAIEKSNDSLRGVLSKNYASPDLDKARLGEVVDLISDISLGDKHAKQSDILGRVYEYFLNEFASQEGKKGGEFYTPRSIVRTLVEMIEPYKGRIYDPCCGSGGMFVQSDKFVQEHQGKIGDLSVYGEESNPTTWKLAKMNLAIRGIDNNLGPHQGDTFTNDLHKGERFDFILANPPFNVKNWNGDKLREDARWQYGVPPVGNANYAWIEHIISKLAPDGKAGFVLANGALSTSTTAEHDIRKAILEDDKIDAIVALPDKMFYSTGIPVSLWFVDMNKESENERDRKGETLFIDARDLGEMIDRTHRAFSKEDIKKVADTYHAYRGTNDQEYKDVPGFCKVAKLDEIAKNDYVLTPGRYVGLAKQEDDGEPYEVKMARLTGELKKQFEESNKLQAEIKDVLKELGYEI

SEQ ID NO: 213 - DNA, 1533 bp, Lactobacillus reuteri
ttggcaactaagtctaaagagctaaatattgaagataaattatggaaggctgctgatgcattgcgtggaagcatggatgcatcagaatatcgtaatgttgtattaggattaatttttcttaagtatgcgtcggattcctttgatgaaagaagacaagagcttttaaaaacagaatatcctgaagatgcagaagatccagacatgtatctagaaaataacattttctgggttcctcaagaggctcgttggtcaaaaatagaacatgctgctaaaacacctcaaattggtgaagtaattgatgatgcaatgaccgcgattgaaaaaaacaatgattcatttcgagggattttgagtaaaaattatgcttcaccagatcttgataaaacacgcttgggtgaagtagtcgatttaatttcggacattaaggttggaactaaagaatctacagataaagatgttttaggtcgtgtttacgaatatttcttaaatgaatttgctagtcaagagggtaaacacggtggtgagttctatacaccacggtcaattgttaaaatcttagttgaaatgattgagccttataaaggacgtatttatgatccttgttgtggttcaggtggaatgtttgttcaatcagaagagttcgttcgtcatcatcagggagagttgaaagatcttcacgtatttggtgaggaatctaacccaactacttggaaattagccaagatgaatttagcgattagaggaattgatagtgatttaggccctcaccaaggcgacactttcactaatgatttacataaaggtgttcgtttcaactacattttggctaatccaccatttaacattaaaaactggggtggcgaaaagcttcaagaagatgctagatggaaatatggtgttccaccaacaggaaatgcaaattatgcctggattgaacatattattagtaagttagcaccggatgggaaagctggctttgttttagctaacggtgccttatcgacttctaataaagaagagtttgcaattcgtaaagcaattttagaagatgataagattgatgcaattgttgctttacctgaaaaaatgttttattcgacaggaattccagtttcattatggtttattgatatgaataaggaatctgaggatgaacgctcgcgaaagggtgaaacattatttattgatgcacgtaatttaggtgagatgattgatcgaactcatcgtgcatttaatgataatgatattaaaaaagtagcagatacttaccatgcttaccgtggtacaaatgatcaagaatataaggatgttgctggcttttgtaaaattgctaagttagatgagatcgctaaaaacgattatgtattaactccgggtcgctatgttggacttgctaaacaagaagatgatggcgaaccatacgaagttaaaatgaagagactaactagtgaattaaaagaacaatttgaggagagtaacaagttacaagcccaaattaaagatgtattgaaggagcttggatatgaaatatag

SEQ ID NO: 214 - protein, 510 aa, Lactobacillus reuteri
MATKSKELNIEDKLWKAADALRGSMDASEYRNVVLGLIFLKYASDSFDERRQELLKTEYPEDAEDPDMYLENNIFWVPQEARWSKIEHAAKTPQIGEVIDDAMTAIEKNNDSFRGILSKNYASPDLDKTRLGEVVDLISDIKVGTKESTDKDVLGRVYEYFLNEFASQEGKHGGEFYTPRSIVKILVEMIEPYKGRIYDPCCGSGGMFVQSEEFVRHHQGELKDLHVFGEESNPTTWKLAKMNLAIRGIDSDLGPHQGDTFTNDLHKGVRFNYILANPPFNIKNWGGEKLQEDARWKYGVPPTGNANYAWIEHIISKLAPDGKAGFVLANGALSTSNKEEFAIRKAILEDDKIDAIVALPEKMFYSTGIPVSLWFIDMNKESEDERSRKGETLFIDARNLGEMIDRTHRAFNDNDIKKVADTYHAYRGTNDQEYKDVAGFCKIAKLDEIAKNDYVLTPGRYVGLAKQEDDGEPYEVKMKRLTSELKEQFEESNKLQAQIKDVLKELGYEI

SEQ ID NO: 215 - DNA, 1554 bp, Lactobacillus reuteri; identical to SEQ ID NO: 17

SEQ ID NO: 216 - protein, 517 aa, Lactobacillus reuteri; identical to SEQ ID NO: 18

SEQ ID NO: 217 - DNA, 1533 bp, Lactobacillus reuteri; identical to SEQ ID NO: 9

SEQ ID NO: 218 - protein, 510 aa, Lactobacillus reuteri; identical to SEQ ID NO: 10

SEQ ID NO: 219 - DNA, 1650 bp, Lactobacillus rhamnosus
atggcagaaaagaatattgcacaagaaatcacttcccagttgtgggcaatggctaacgaactccgaggtaacatggatgcaagcgagtttcgaaactacattctaggattcatgttttatcgttatttaagtgagcatcaagaacgatatttgcaggaaacaaaccttttcgaacctgaagcgggtcagacttggaacgatgcttttcgcgaagtagctagtgatccggaatcacgaaaagaatatcttgaagacatctcaagcgagttaggttatgcgattgcacctgagcagacatgggcgtcacttgttcaaaaggttaatgacgacaagatcgttccatccgattatcaagatctatttgatgactttaataagaacgctgcgctcaatccgaattctgaagcagactttcgcggaatattcgctgatattaatctcggtgattcgcgcctcggcagttcaaccacagcgcgggcgaaggctttaaacggagttgtccgcttagttgaccaatttgaatataacgataagcaaggtcgagatattcttggcgatgtgtatgaatacttaatcgcccaatttgccgggaactctggtaagaaggctggcgaattctatacgccgcatcaggtttctaaagtgttagccaaattagttgcgctgggtgttcaaaaaaatcaggaaatctttaccgtctatgaccctacgatgggttctggatccttgttgctgacggtgagagatgaactgcccgcaactgtaaaagctgttatgttccatgggcaagaattaaacacgaccacttttaacttagcccgaatgaacctaatgatgcataacgtgccatatacaaacatgagtctcagaaatgccgatacattggaagatgattggcctgacggtgttgtgggaggggttgactcaccccgtagttttgatgcagtagttgcaaacccaccatattccattcattgggataatagcgaaaataagttgaaagacccccgatttaagccgtttggcgcgctggcaccgaaaagtaaggctgactttgcttttgttgagcatggactttaccatttgaatgatactggcaccatggccattgtccttccccatggtgttttatttaggggtgcagctgaaggaaagattcgcaaggccattattgagaagaactatttagatgctgtgattggtatgcctgcagggctctttttctcaacaggaatcccaactgttgttttggtcttcaaaaagaaccgaactaaccgagatatctttttcattgatgctagcaacgactttgaaaaaggtaaaaaccagaacatcttgcgcgatagtgatatcgacaagatcattgaggcgtattccaaacgtgaggatgttgataaatacgcgcacaaagctgagctcgatgagattatggaaaacgaatacaatctcaatattcctcgctatgtagacacaaccgaacctgagaaaccaatagatgttgttcaggtagtagcaaatattaaagagtctgacaagaagatcgccaagttatctagtgaattagctaaggacattgatgatttggtggcaaataatgatgaagcagcgaaacagcttgctgccctgaaggagctgtttaaaaatgagtaa

SEQ ID NO: 220 - protein, 549 aa, Lactobacillus rhamnosus
MAEKNIAQEITSQLWAMANELRGNMDASEFRNYILGFMFYRYLSEHQERYLQETNLFEPEAGQTWNDAFREVASDPESRKEYLEDISSELGYAIAPEQTWASLVQKVNDDKIVPSDYQDLFDDFNKNAALNPNSEADFRGIFADINLGDSRLGSSTTARAKALNGVVRLVDQFEYNDKQGRDILGDVYEYLIAQFAGNSGKKAGEFYTPHQVSKVLAKLVALGVQKNQEIFTVYDPTMGSGSLLLTVRDELPATVKAVMFHGQELNTTTFNLARMNLMMHNVPYTNMSLRNADTLEDDWPDGVVGGVDSPRSFDAVVANPPYSIHWDNSENKLKDPRFKPFGALAPKSKADFAFVEHGLYHLNDTGTMAIVLPHGVLFRGAAEGKIRKAIIEKNYLDAVIGMPAGLFFSTGIPTVVLVFKKNRTNRDIFFIDASNDFEKGKNQNILRDSDIDKIIEAYSKREDVDKYAHKAELDEIMENEYNLNIPRYVDTTEPEKPIDVVQVVANIKESDKKIAKLSSELAKDIDDLVANNDEAAKQLAALKELFKNE

SEQ ID NO: 221 - DNA, 1650 bp, Lactobacillus rhamnosus
atggcagaaaagaatattgcacaggaaatcacttcccagttgtgggcaatggctaacgaactccgaggcaacatggatgcaagcgaattccggaactacatcctaggattcatgttttatcgttatttaagtgagcatcaagaacgttatttgcaggaaacaaacctatttgaacctgaagcgggtcagacttggaacgatgcttttcgcgaagtagctagtgatccggaatcacgaaaagaataccttgaagacatctcaagcgaattaggttatgcgattgcacctgagcagacatgggcgtcacttgttcaaaaggtgaatgacgacaaaatcgttccatccgattaccaagatctatttgatgactttaataagaacgctgcgctcaatccgaattctgaagcggacttccgcggaatcttcgctgatattaatctcggtgattcgcgtctcggcagttcaaccacagcgcgagcaaaggctttaaacggggttgtccgcttagttgaccaatttgaatataacgataagcaaggtcgagatatccttggcgatgtgtatgaatacttaatcgcccaatttgctgggaactctggtaagaaggctggcgaattctatacgccgcatcaggtttctaaagtgttggccaaattagttgcgctgggtgttcaaaaagatcaggaaatctttaccgtctatgaccctacgatgggctctggatctttgttgctgacggtgagagatgaactgcccgcaactgtaaaagctgttatgttccatggacaagaattaaatacgaccacttttaacttagcccgaatgaacctaatgatgcataacgtgccatatacaaacatgagcctcagaaatgccgatacattggaggatgattggcctgacggtgttgtgggaggggtcgactcgccccgcagctttgatgcagtagttgcaaacccaccatattccattcattgggataatagcgaaaacaagttgaaggacccccgatttaagccttttggcgcgctggcaccgaaaagtaaggctgactttgcttttgttgagcatggactttaccatttgaatgatactggcaccatggccattgtccttcctcatggtgttttgtttaggggtgcagctgagggaaagattcgcaaggccattattgagaagaactatttagatgctgtgattggtatgcctgcagggctctttttctcaacagggatcccaactgttgttttggtcttcaaaaagaaccgaaccaaccgagatatctttttcattgatgctagcaacaactttgaaaaaggtaaaaaccagaacatcttgcgcgatagtgatattgacaagatcattgaggcgtattccaaacgtgaagatgttgacaaatatgcgcacaaagctgagctcgatgagattgtagagaacgaatataatctcaatatccctcgctatgtagatacaaccgaacctgagaaaccaatagatgttgttcaggtagtagcggatatcaaggagactgacaagaagatcgccaagttatctagtgaattagctaaggacattgatgatttggtggcaaataatgatgaagcagcgaaacagcttgctgctttgaaggagctgtttaaaaatgagtaa

SEQ ID NO: 222 - protein, 549 aa, Lactobacillus rhamnosus
MAEKNIAQEITSQLWAMANELRGNMDASEFRNYILGFMFYRYLSEHQERYLQETNLFEPEAGQTWNDAFREVASDPESRKEYLEDISSELGYAIAPEQTWASLVQKVNDDKIVPSDYQDLFDDFNKNAALNPNSEADFRGIFADINLGDSRLGSSTTARAKALNGVVRLVDQFEYNDKQGRDILGDVYEYLIAQFAGNSGKKAGEFYTPHQVSKVLAKLVALGVQKDQEIFTVYDPTMGSGSLLLTVRDELPATVKAVMFHGQELNTTTFNLARMNLMMHNVPYTNMSLRNADTLEDDWPDGVVGGVDSPRSFDAVVANPPYSIHWDNSENKLKDPRFKPFGALAPKSKADFAFVEHGLYHLNDTGTMAIVLPHGVLFRGAAEGKIRKAIIEKNYLDAVIGMPAGLFFSTGIPTVVLVFKKNRTNRDIFFIDASNNFEKGKNQNILRDSDIDKIIEAYSKREDVDKYAHKAELDEIVENEYNLNIPRYVDTTEPEKPIDVVQVVADIKETDKKIAKLSSELAKDIDDLVANNDEAAKQLAALKELFKNE

SEQ ID NO: 223 - DNA, 1650 bp, Lactobacillus rhamnosus
atggcagaaaagaatattgcacaggaaatcacttcccagttgtgggcaatggctaacgaactccgaggcaacatggatgcaagcgaattccggaactacatcctaggattcatgttttatcgttatttaagtgagcatcaagaacgttatttgcaggaaacaaacctatttgaacctgaagcgggtcagacttggaacgatgcttttcgcgaagtagctagtgatccggaatcacgaaaagaataccttgaagacatctcaagcgaattaggttatgcgattgcacctgagcagacatgggcgtcacttgttcaaaaggtgaatgacgacaaaatcgttccatccgattaccaagatctatttgatgactttaataagaacgctgcgctcaatccgaattctgaagcggacttccgcggaatcttcgctgatattaatctcggtgattcgcgtctcggcagttcaaccacagcgcgagcaaaggctttaaacggggttgtccgcttagttgaccaatttgaatataacgataagcaaggtcgagatatccttggcgatgtgtatgaatacttaatcgcccaatttgctgggaactctggtaagaaggctggcgaattctatacgccgcatcaggtttctaaagtgttggccaaattagttgcgctgggtgttcaaaaagatcaggaaatctttaccgtctatgaccctacgatgggctctggatctttgttgctgacggtgagagatgaactgcccgcaactgtaaaagctgttatgttccatggacaagaattaaatacgaccacttttaacttagcccgaatgaacctaatgatgcataatgtgccatatacaaacatgagcctcagaaatgccgatacattggaggatgattggcctgacggtgttgtgggaggggtcgactcgccccgcagctttgatgcagtagttgcaaacccaccatattccattcattgggataatagcgaaaacaagttgaaggacccccgatttaagccttttggcgcgctggcaccgaaaagtaaggctgactttgcttttgttgagcatggactttaccatttgaatgatactggcaccatggccattgtccttcctcatggtgttttgtttaggggtgcagctgagggaaagattcgcaaggccattattgagaagaactatttagatgctgtgattggtatgcctgcagggctctttttctcaacagggatcccaactgttgttttggtcttcaaaaagaaccgaaccaaccgagatatctttttcattgatgctagcaacaactttgaaaaaggtaaaaaccagaacatcttgcgcgatagtgatattgacaagatcattgaggcgtattccaaacgtgaagatgttgacaaatatgcgcacaaagctgagctcgatgagattgtagagaacgaatataatctcaatatccctcgctatgtagatacaaccgaacctgagaaaccaatagatgttgttcaggtagtagcggatatcaaggagactgacaagaagatcgccaagttatctagtgaattagctaaggacattgatgatttggtggcaaataatgatgaagcagcgaaacagcttgctgctttgaaggagctgtttaaaaatgagtaa

SEQ ID NO: 224 - protein, 549 aa, Lactobacillus rhamnosus; identical to SEQ ID NO: 222

SEQ ID NO: 225 - DNA, 1623 bp, Lactobacillus rhamnosus
atgtcagaaaaaacaactcaagctagtcagcttgaaagcgccctatggaatgcggccgatgtcttacgcgggaaaatggacgcttccgaatataaaaattatttattagggttaattttttatcggtttctatccgagaaaaccttaacgacttttagtgattgggcaggcgaaactgaaaatgtcacccagaaatatgctcagtatatgaatcctcagtttgagttggaaggcgtttcagtgcagcccagtttagtggagtatttgcaaaacacgctcggctatttaattcaaccccaggcgttgtacgccaccctgattggcaagattcaagcccatacttttgcgttagacgatttatctcaagcacttcatgatctggaacagtcgacacaaaatctatcttcagcgcaagacttttcgggcttgtttgccgatgtggatttaagtagtaataaattaggcagttctttacaacaacggaaccaaactattagtgatactatgttagctttaaatgcgattgatcttatccatcatcaaggcgacgtcctaggtgacgcctatgaatacttaatcgcgcaatttgccagtgattccggtaaaaaagcgggtgaattttataccccgcggcaggtgtccgacattattgctcagattgtgacttatcaacgtaatgcaggtgataaccaagtgcggactatctatgatccagcagttggttctggttcactgctattaaatgtgggacaacatgtgcaagatcccagtttagtgagttatcatggtcaggaattaaacacgacgacctttaacctagcccgaatgaatttaatgttgcatggggtttcttatgatgatatgcacttacgcaacggggatacgttaagtaaagattggcccgttgacgagccttacttatttgatgccgtcgttatgaacccgccctactcggcgcactgggataacagcgacaaacgcttgtcagaccctcgattccgtgattatggtgtcttaccgcctaaatcaaaagccgactttgcctttctgctacacggcttttatcatttacaagagcacggaactatgggcattgtcctaccccatggcgtattgtttcggggggctaaggaaggcaaaattcgccaaaagcttctgttagataaccggattgatgccattattgggctacccgctaatatttttcattccaccagtattccaacgttgatcatgattttaaagaaacataaaaccactgatgacgtcttatttattgatgcgtctcgggaatttgaaaaggacaagaatcaaaataagctaacggcagtgaatattcaaaaaattgtgaccacttatcaaaaccggcaggatgtcgataaatatgcccatgtggcctcaccggcggaaatcaaggaaaatgattataatttaaacattccgcgctacgttgatacgtttgaaccggaacccgagattgatttggaccaagttaaagctgatctaaagcaactggacgaggcaatcagtcatcatgaacaagcttttaatgaattggctagccagttagtggtcacccaggtaaatgaccagtcaaaaccggaggcccacaatgaaggataa

SEQ ID NO: 226 - protein, 540 aa, Lactobacillus rhamnosus
MSEKTTQASQLESALWNAADVLRGKMDASEYKNYLLGLIFYRFLSEKTLTTFSDWAGETENVTQKYAQYMNPQFELEGVSVQPSLVEYLQNTLGYLIQPQALYATLIGKIQAHTFALDDLSQALHDLEQSTQNLSSAQDFSGLFADVDLSSNKLGSSLQQRNQTISDTMLALNAIDLIHHQGDVLGDAYEYLIAQFASDSGKKAGEFYTPRQVSDIIAQIVTYQRNAGDNQVRTIYDPAVGSGSLLLNVGQHVQDPSLVSYHGQELNTTTFNLARMNLMLHGVSYDDMHLRNGDTLSKDWPVDEPYLFDAVVMNPPYSAHWDNSDKRLSDPRFRDYGVLPPKSKADFAFLLHGFYHLQEHGTMGIVLPHGVLFRGAKEGKIRQKLLLDNRIDAIIGLPANIFHSTSIPTLIMILKKHKTTDDVLFIDASREFEKDKNQNKLTAVNIQKIVTTYQNRQDVDKYAHVASPAEIKENDYNLNIPRYVDTFEPEPEIDLDQVKADLKQLDEAISHHEQAFNELASQLVVTQVNDQSKPEAHNEG

SEQ ID NO: 227 - DNA, 1392 bp, Lactobacillus salivarius
atggataaagatttagaagaaagattagcagctaaagatagctatatcgacattcatgacttttatgtgctaatggcattttatcaatcaatctcacaaaaagttttacggaaattcgataaggatggcagcattttagaagtacagaaaaaatatgaggaaggtaaggaaacggtccaggatgctcaattcgtaatagcgccacaagatacatattatcatcattaccaaatgtataaggccaataaatttgaatatgttgaactcgtaaaatccctatataatatagaagaaaaaaatccaaaattaaaaaatatcttccaagatgttaggggaagtacttcaagtttaccgagcgaaactgcttttgaaaagatagattcacgtaatgaagtaagttttgaagaaaatttagagataattaaacgaagcagtggtgctaaagataattacgattatacttcgaaaaatatccgtaagttgattactaagttagttggaagtaaaaaagaaggagtatcaatttatgatccagctttgggaacagcgagtttactattgggtataaatcgagctgcacttaaagaaaataagtattatggacaagaaatcaatactcaagtgataaaaatagccattatgaacgcaataattaatgacgtggctgatgataaatttgaattcaagaatgcaaatacattggctaataattgggaatttggtaaggctgatatagtagtgtctgatccaccaatgagtatgaaatggaacattgataaaaatttaagtcaagataaacgttatcaagattatggagatttgcctaatagagcagattggggattcattttggatggaatcgataaattgtcaaatgatggaatgatgattgtgtcggttgttcaaggtacgctgtttagaggggccaaagaatacaatattagacgtaaacttctagaagatggaaagattagggcggtaatccagttgccagggaatacgaaactttcgacaacaatcgctacttgtttgctagtatttagaaaatcatcagaagataaagatgtctttttcattaatgcaagccaagagtatgagaagaaaggcttggaaaatattctaacagaagccaatatcgataaaattgtagatatttttaatgaaaagaaagaagaaaaaggattctcacatgtagcgagctatgaagaaattgagaaaaatgactttaacctatcagtagcacgttatgtaaatcagtataaatttaaagagaaattggattatcaagaagaaataaagaatcttgaaaagttagatgaaaaactaagtcaaactgatgcgacattgaagaatttgatgggagatttaggtttgatggagattgataactag

SEQ ID NO: 228 - protein, 463 aa, Lactobacillus salivarius
MDKDLEERLAAKDSYIDIHDFYVLMAFYQSISQKVLRKFDKDGSILEVQKKYEEGKETVQDAQFVIAPQDTYYHHYQMYKANKFEYVELVKSLYNIEEKNPKLKNIFQDVRGSTSSLPSETAFEKIDSRNEVSFEENLEIIKRSSGAKDNYDYTSKNIRKLITKLVGSKKEGVSIYDPALGTASLLLGINRAALKENKYYGQEINTQVIKIAIMNAIINDVADDKFEFKNANTLANNWEFGKADIVVSDPPMSMKWNIDKNLSQDKRYQDYGDLPNRADWGFILDGIDKLSNDGMMIVSVVQGTLFRGAKEYNIRRKLLEDGKIRAVIQLPGNTKLSTTIATCLLVFRKSSEDKDVFFINASQEYEKKGLENILTEANIDKIVDIFNEKKEEKGFSHVASYEEIEKNDFNLSVARYVNQYKFKEKLDYQEEIKNLEKLDEKLSQTDATLKNLMGDLGLMEIDN

SEQ ID NO: 229 - DNA, 2073 bp, Lactobacillus salivarius
gtggaaaagacaatagcgacatgggatgaacaaccaatagatattacaagtgaagcaaactttatttggggcattgctaaaaaattaagaggaacatatctacctgacaaatatggtgatgttattatcccaatgacaattattcggcgatttgaaagtgtcttggaaccaactaaagataaggttatagcgcaatttgaggcaatgccaacttatccagcaagagcaatgtacaaaattagcggttaccaattctataacactagtaaatttgatttagcagaactatgtaatgatccagataatattgctgctaactttaaagcatacttaaatggattttcagcagatgttcaagaaattttacaaaatttagatattgaaagtcatataaataagatggacaaagggggatgtctatattcagttgttaaagctttttcagaattggatcttagtgtagaaaaattcgatagcattaagatgggttatatctttgagaacttaattgcacgtttttatcaaaatgtggaagcagggcaattctataccggtcgtgatattattcggttatgtgtctcattgttacttgcagaaggtagcgatgatattacagaagaaaacaaggtaatcacagttttagatcaagcttgcggaactggaggtatgctttcaacagcatatagttatcttaagaatatcaatccaactgctaatgttcatttatttggtcaagaattaatgggacaatcttatgcagttggtttggctgaaatgttaattaaaaatcaaaatattgataacttcagacatgctgatacacttcaagttgattgttttcctaatcaaaaaatgcgttatgtcttagaaaatccgccatttggaactccatggggtggcaaagatgctaaacaaggtcaagaagaagcagtaaaagaagagtatcttaaaggcgagaaaagtcgttggggtgctggattacctaagtctaatgatgcccaacttctatttgttcaatctgctttaaataagcttgaaaagaatggccgagctgcaattattgagaatggatcaccactctttactggcggaacttcatcaggtgaatcacaagttcgtagatggttattagagaatgattatttagatgcaattgttgctttaccaactgatcttttttataacacgagtttagcaacctacatttggattttaactaaggataagtcacaaaaacgcaaagggaaagtacaatttattgatgcaactaatatctacgaaactttacgtaaaccactgggaaataagaaacgtgaattttcaccagctaatcgagaaaagattacaaaattatatactgactatcaggaaaatgagctttcccaaattcatgataattcagagtttatctatcgtgagtactcagttatgcaaccgttgcagcgaagttatgctattaataacgagcggattgaaacgatggttgctaatttaagtaatttctttgatcaggtaaaatttgatgatttaaacaatagtgaagaaaagttatcagctaaggaacaaaagcaacttgctaaattacaaaagaacaagccagcttacgatcaattactagcatctttggaggctaataagtcagaaaaagtttataaatcattgggtgagtttgaaccagtgattacagaattattaagtgaaattgttgataaaaaggtaatcaaaaaggtaattgatggtttatctaagatggataaaacagcagaaatccagacagataaaaaaggcaatattctttacgataaggatacagaagatacagaaatcgtcaatatcaatacttcaattgacgattatatggtcaaggaagtattgccttttgtacctgatgctaaagcattctttaatgaagatttaggaaagaagaagccggttattaagactggggcagagatgccatttacccgttatttctaccaatatcaaaagccagagtctgtggatgtattagtagataaaattagaaacttagaaagtgaaattaacgcaggaatgcaggatttatttaagtag

SEQ ID NO: 230 - protein, 690 aa, Lactobacillus salivarius
MEKTIATWDEQPIDITSEANFIWGIAKKLRGTYLPDKYGDVIIPMTIIRRFESVLEPTKDKVIAQFEAMPTYPARAMYKISGYQFYNTSKFDLAELCNDPDNIAANFKAYLNGFSADVQEILQNLDIESHINKMDKGGCLYSVVKAFSELDLSVEKFDSIKMGYIFENLIARFYQNVEAGQFYTGRDIIRLCVSLLLAEGSDDITEENKVITVLDQACGTGGMLSTAYSYLKNINPTANVHLFGQELMGQSYAVGLAEMLIKNQNIDNFRHADTLQVDCFPNQKMRYVLENPPFGTPWGGKDAKQGQEEAVKEEYLKGEKSRWGAGLPKSNDAQLLFVQSALNKLEKNGRAAIIENGSPLFTGGTSSGESQVRRWLLENDYLDAIVALPTDLFYNTSLATYIWILTKDKSQKRKGKVQFIDATNIYETLRKPLGNKKREFSPANREKITKLYTDYQENELSQIHDNSEFIYREYSVMQPLQRSYAINNERIETMVANLSNFFDQVKFDDLNNSEEKLSAKEQKQLAKLQKNKPAYDQLLASLEANKSEKVYKSLGEFEPVITELLSEIVDKKVIKKVIDGLSKMDKTAEIQTDKKGNILYDKDTEDTEIVNINTSIDDYMVKEVLPFVPDAKAFFNEDLGKKKPVIKTGAEMPFTRYFYQYQKPESVDVLVDKIRNLESEINAGMQDLFK

SEQ ID NO: 231 - DNA, 1392 bp, Lactobacillus salivarius
atggataaggatttagaagaaagattagcagttaaagatagctatatcactattcatgacttttatgtgttaatggcattttatcaatcaatttcacaaaaagttttacgaaaatttgataaagatggcagcattttagaagtacaaaaaaaatatgaagaaagtagggagactgttcaggatgctcaattcgtaatagcgccacaagatacatattatcatcattaccaaatgtataaggccaataaatttgaatatgttgaactcgtaaaatctctatataatatagaagaaaaaaatccaaaattaaaaaatatcttccaagatgttagcggaagtacttcaagtttaccgagtgaaactgcttttgaaaagatagattcacgtaatgaagtaagttttgaagaaaatttagaaataattaagcgaagcagtggcgctagggataattacgattatacttcgaaaaatatccgtaagttgattactaaattagttggaagtaaaaaagaaggagtatcaatttatgatccagctttgggaacagcgagtttactgttaggtataaatcgagatgcacttaaagaaaataaatattatggacaagaaatcaatactcaagtgataaaaatagccattatgaacgcaatagttaatgatgtagatgatgataaatttgaatttaagaatgaaaatacattggctaataactgggaatttggcaaggttgatatagtagtgtctgatccacctataaatatgaaatggaatgttgatagaaatttaagtcaagatagacgttaccgagattatggtgagatgcctaacaaagctgattggggattcattttagatggaatagataaattatcagacaatggcatgatggttgtgtcagttgttcaaggtacgctgtttagaggagccaaagaatacaatattagacgtaaacttctagaagatggaaagattagggcggtaatccagttgccagggaatacaaaaatttcaactacaatcgcaacttgcttattagtgcttagaaaatcatcagaagataaagatgtcttctttattaatgcaagccaagagtatgagaagaaaggcttggaaaatattctaacagaagccaatgtcgataaaattgtagatatttttaatgaaaagaaagaagaaaaaggattctcacatgtagcgagctatgaagaaattgagaaaaatgattttaacctatcagtagcacgttatgtaaatcagtataagtttaaagaaaaattagattatcaagaagaaataaaaaatcttgaaaagttagatgaaaaactaagtcaaactgatgcgacattgaagaatttgatgggtgatttaggtttgatggagattaataactag

SEQ ID NO: 232 - protein, 463 aa, Lactobacillus salivarius
MDKDLEERLAVKDSYITIHDFYVLMAFYQSISQKVLRKFDKDGSILEVQKKYEESRETVQDAQFVIAPQDTYYHHYQMYKANKFEYVELVKSLYNIEEKNPKLKNIFQDVSGSTSSLPSETAFEKIDSRNEVSFEENLEIIKRSSGARDNYDYTSKNIRKLITKLVGSKKEGVSIYDPALGTASLLLGINRDALKENKYYGQEINTQVIKIAIMNAIVNDVDDDKFEFKNENTLANNWEFGKVDIVVSDPPINMKWNVDRNLSQDRRYRDYGEMPNKADWGFILDGIDKLSDNGMMVVSVVQGTLFRGAKEYNIRRKLLEDGKIRAVIQLPGNTKISTTIATCLLVLRKSSEDKDVFFINASQEYEKKGLENILTEANVDKIVDIFNEKKEEKGFSHVASYEEIEKNDFNLSVARYVNQYKFKEKLDYQEEIKNLEKLDEKLSQTDATLKNLMGDLGLMEINN

SEQ ID NO: 233 - DNA, 1590 bp, Lactobacillus salivarius
atggcacaagaagaagttactttagaaagatcattagataatgcagctaatgtattacgttcaaaaatggatgctaatgaatataaaaattatacgttaggcactattttctataaatatctatctgatagtatgctgtattatgtagctgaattattggaagaaaaaaatattagcttagaagaagctcagaaattatatgaagaaaatcaagatgatcagtatttaattgaagaattagatattaaatttaattatgtgatagaagctaaaaacacttatacaaatatattaaaatctataaacaatcatacctttcaggttagtcaattaggcgatgcttttaatagtattgaaagtcaaggaaaagaatttgaaggtttatttgacgattatgatttgtattctaagcgtttaggaaacactgcacaaaagcaatctgatacaatttcagaagtactaagtgcaattggtaaattagaaattgttaaaactccagaagacactttaggaaatgcatatgaatatttaattaaacaatttgcatctgaatcaggtaaaaaggctggtgaattttatacaccacaaaaagtatctagattattagcaagattaactttagttgataaggattatacagatggaatgactgtatatgatccaacaatgggttcaggttcattattattgaatttccgtaaatatgtggaacattctgaaagaattacttattttggtcaagaaattaatacttcaacatataacttggcgcgtatgaatatgattttgcaccatgtagatgttgttaatcaaaaactccgaaataatgatactcttgatgaggattggccagttgaagaaataactaactttgatgcggttgtaatgaatccaccatattctcataagtggtctgccaatgctggttttaaagatgatccacgtttttccgcctatggagttttgccgccaaaatctaaagctgactatgctttcttgttacatgggtattatcatttgaaacatagcggagtaatggctattgttttacctcatggaatattgttcagaggagcagcagaaggtaaaatcagaaagaaattgttagaaaatggggcaatagacgcggttatcggtttaccagctaacttgttctataacacaagtattccaactacgatcgttgttttgaagaaagataagcaagatcgcgatgtattattcattgatgcttcaaaaaattttaaaaaagttaagacacaaaatgaactacgtgacgaagatgtagaaaaaattcttacaacatataaagagcgtaaggatattgataaatatgcccacttagctagttttgatgagattaaagaaaatgaatttaacttaaatattccacgttatgtagatacttttgagcctgaaccagaaattaatttagatgaagtttcaaaagaattaagagaaacgaatgagaaaatcaaagaaaatgaaactgaattgattagtatgctaaaagatttaacttctaaagatgagaagattatgaaaggcttaaatgacttcataagtgtcttagaagaggatgtgaaataa

SEQ ID NO: 234 - protein, 529 aa, Lactobacillus salivarius
MAQEEVTLERSLDNAANVLRSKMDANEYKNYTLGTIFYKYLSDSMLYYVAELLEEKNISLEEAQKLYEENQDDQYLIEELDIKFNYVIEAKNTYTNILKSINNHTFQVSQLGDAFNSIESQGKEFEGLFDDYDLYSKRLGNTAQKQSDTISEVLSAIGKLEIVKTPEDTLGNAYEYLIKQFASESGKKAGEFYTPQKVSRLLARLTLVDKDYTDGMTVYDPTMGSGSLLLNFRKYVEHSERITYFGQEINTSTYNLARMNMILHHVDVVNQKLRNNDTLDEDWPVEEITNFDAVVMNPPYSHKWSANAGFKDDPRFSAYGVLPPKSKADYAFLLHGYYHLKHSGVMAIVLPHGILFRGAAEGKIRKKLLENGAIDAVIGLPANLFYNTSIPTTIVVLKKDKQDRDVLFIDASKNFKKVKTQNELRDEDVEKILTTYKERKDIDKYAHLASFDEIKENEFNLNIPRYVDTFEPEPEINLDEVSKELRETNEKIKENETELISMLKDLTSKDEKIMKGLNDFISVLEEDVK

SEQ ID NO: 235 - DNA, 1533 bp, Lactobacillus sakei
atggctaagaaaacggcagaactaaaaattgaagatgctttgtggcaagcggctgaccaattgcgtggaagtatggatgcttcccaatatcgtaacgtggttttgggattaatttttttgaagtacgtatctgattcttttaatgaaaagtacgaatcattgatcaagtcagattaccctgaagacgcggaagatcgtgatatgtatacggctgaaaatatcttttggctaccaaaagaagcacgttgggatgtgattgcttcggacgcaaagacacctgaaattggtgagactatcgataaagcaatggaagcaatagagcgagaaaacgatcaaataaagggtgtgctgccaaagaattacgcatcaccagatctggataaggttcgtcttggtggagttattgatcttatttcgaatatcaaagttggtgatgaagagtcgcgaaagaatgatgtgttgggccgcgtgtatgattactttttgagcaatttcgctgcacaagaaggtaagaatggtggagaattctatacgcctcgttcaatcgtccgtacacttgttgagatgctggagccgtacaagggacgcatttatgaccctgcggctggttctggtggaatgttcgttcaatcggaagaatttgttcgtgagcaccaaggtgttatttcagatttatcagtgtatggtcaagaagctaacccaactacttggaaattggcaaagatgaatttggcgattcgtggaattgataatgactttggacctcatcaaggggatacgttcacaaatgatttgcacaagggaagacgttttgactacattcttgctaacccgcctttcaatttgaaggagtggggggcagataagcttcaagacgactcccgttgggtttatggcgttccgcctgaaggaaatgccaattacgcttggattgaacacatgattagcaagttggcgcctgatggtaaggccgggtttgtgttggcaaatggtgcgctttcaacaagcacaaaggaagagtatgcaattcgaaaggcgattctcgaggctgataagattgatgcgattgtcgccttgccaggtcaaatgttttattcaacgcagattccagtctctctttggtttgttgatatgaataaagcttcgagcgatgaacgcaagcgcaacggcgagactttatttattgatgcacgtgagttaggatttatggcagatcgaacgcataaggaattcgcacgggaagatattgctaagattgcagatacttaccatgcctaccgtgggactaatgaccaggtctatgaagatgtaccaggctttagtaaagcggctatgattgaagagattcgtgagaatgactacgttttgacacctggtcgttatgtaggtcttgctgaacggcaagacgatggtgaaccgtacgaagagaagatggctcgactaacatctgaactttcagaccaattcaaaaagagcgccgaactggaagaacaaattcgtgacgctctaaaggagattggttatgatatttag

SEQ ID NO: 236 - protein, 510 aa, Lactobacillus sakei
MAKKTAELKIEDALWQAADQLRGSMDASQYRNVVLGLIFLKYVSDSFNEKYESLIKSDYPEDAEDRDMYTAENIFWLPKEARWDVIASDAKTPEIGETIDKAMEAIERENDQIKGVLPKNYASPDLDKVRLGGVIDLISNIKVGDEESRKNDVLGRVYDYFLSNFAAQEGKNGGEFYTPRSIVRTLVEMLEPYKGRIYDPAAGSGGMFVQSEEFVREHQGVISDLSVYGQEANPTTWKLAKMNLAIRGIDNDFGPHQGDTFTNDLHKGRRFDYILANPPFNLKEWGADKLQDDSRWVYGVPPEGNANYAWIEHMISKLAPDGKAGFVLANGALSTSTKEEYAIRKAILEADKIDAIVALPGQMFYSTQIPVSLWFVDMNKASSDERKRNGETLFIDARELGFMADRTHKEFAREDIAKIADTYHAYRGTNDQVYEDVPGFSKAAMIEEIRENDYVLTPGRYVGLAERQDDGEPYEEKMARLTSELSDQFKKSAELEEQIRDALKEIGYDI

SEQ ID NO: 237 - DNA, 1398 bp, Lactobacillus salivarius
atggataaggatttagaagaaagattagcagctaaagatagctatatcactattcatgacttttatgtgttaatggcattttatcaatcaatttcacaaaaagttttacgaaaatttgataaagatggcagcattttagaagtacagaaaaaatatgaagaaagtagggagactgttcaggatgctcaattcgtaatagcgccacaagatacatattaccatcattaccaaatgtataaggccaataaatttgaatatgttgaactcgtaaaatccctatataatatagaagaaaaaaatccaaaattaaaaaatatcttccaagatgttaggggaagtacttcaagtttaccgagcgaaactgcttttgaaaaggtagattcacgtaatgaagtaagttttgaagaaaatttagaaataattaagcggagcagtggcgctaaagataattacgattatacttcgaaaaatatccgtaagttgattactaagttagttggaagtaaaaaagaaggagtatcaatttatgatccagctttaggaactgcgagtttattattaggcataaatcaagctgcactcaaagagaatagatattatggtcaagatatcagtactcaagcgataaagacagccattatgaacgtaatagttaatgatgtagatgatgataaatttgaatttaagaatgaaaatacattggctaataactgggaatttggcaaggttgatatagtagtgtctgatccacctataaatatgaaatggaatgttgatagaaatttaagtcaagatagacgttaccgagattatggtgagatgcctaataaagctgattggggattcattttagatggaatagataaattatcagacaatggcatgatggttgtgtcagttgttcaaggtacgctgtttagaggagccaaagaatacaatattagacgtaaacttctagaagatggaaagattagggcggtaattcagttgccagggaatacgaaactttcgacaacaatcgctacttgtttgctagtatttagaaaatcatcagaagataaagatgtctttttcattaatgcaagccaagagtatgagaagaaaggcttggaaaatattctaacagaagccaatgtcgataaaattgtagatactttcaatgaaaagaaagaagtacagagattctctcatatggctaactatgaagaaattgagaaaaacgactttaacctatcagtagcacgttatgtaaatcagtataagtttaaagagaaattggattatcaagaagaaataaaaaatcttgaaaagttagatgaaaaactaagtcaaactgatgcgacattgaagaatttgatgggagatttaggtttgatggagattaatgaccaaaaataa

SEQ ID NO: 238 - protein, 465 aa, Lactobacillus salivarius
MDKDLEERLAAKDSYITIHDFYVLMAFYQSISQKVLRKFDKDGSILEVQKKYEESRETVQDAQFVIAPQDTYYHHYQMYKANKFEYVELVKSLYNIEEKNPKLKNIFQDVRGSTSSLPSETAFEKVDSRNEVSFEENLEIIKRSSGAKDNYDYTSKNIRKLITKLVGSKKEGVSIYDPALGTASLLLGINQAALKENRYYGQDISTQAIKTAIMNVIVNDVDDDKFEFKNENTLANNWEFGKVDIVVSDPPINMKWNVDRNLSQDRRYRDYGEMPNKADWGFILDGIDKLSDNGMMVVSVVQGTLFRGAKEYNIRRKLLEDGKIRAVIQLPGNTKLSTTIATCLLVFRKSSEDKDVFFINASQEYEKKGLENILTEANVDKIVDTFNEKKEVQRFSHMANYEEIEKNDFNLSVARYVNQYKFKEKLDYQEEIKNLEKLDEKLSQTDATLKNLMGDLGLMEINDQK

SEQ ID NO: 239 - DNA, 1590 bp, Lactobacillus salivarius
atggcacaagaagaagttactttagaaagatcattagataatgcagctaatgtattacgttcaaaaatggatgctaatgaatataaaaattatacgttaggtactattttctataaatatctatctgatagtatgctgtattatgtagctgaattattggaagaaaaaaatattagcttagaagaagctcagaaattatatgaagaaaatcaagatgatcagtatttaattgaagaattagatattaaatttaattatgtgatagaagctaaaaacacttatacaaatatattaaaatctataaacaatcatacctttcaggttagtcaattaggcgatgcttttaatagtattgaaagtcaaggaaaagaatttgaaggtttatttgacgattatgatttgtattctaagcgtttaggaaacactgcacaaaagcaatctgatacaatttcagaagtactaagtgcaattggtaaattagaaattgttaaaactccagaagacactttaggaaatgcatatgaatatttaattaaacaatttgcatctgaatcaggtaaaaaggctggtgaattttatacaccacaaaaagtatctagattattagcaagattaactttagtcgataaggattatacagatggaatgactgtatacgatccaacaatggggtcaggttcattattattgaatttccgtaaatatgtggaacatcctaaaagaattacttattttggtcaagaaattaatacttcaacatataacttggcgcgcatgaatatgattttgcaccatgtagatgttgttaatcaaaaactccgaaataatgatactcttgatgaagattggccagttgaagaaataactaactttgatgcagttgtaatgaatccaccatattctcataagtggtctgccaatgctggttttaaagatgatccacgtttttccgcctatggagttttgccgccaaaatctaaagctgactatgctttcttgttacatgggtattatcatttgaaacatagtggggtaatggccattgttttacctcatggaatattattcagaggggcagcagaaggtaaaatcagaaagaaattgttagaaaatggggcaatagacgcggttatcggtttaccagctaacttgttctataacacaagtattccaactacgattgtcgttttgaagaaagataagcaagatcgcgatgtattattcattgatgcttcaaaagattttgaaaaagttaagacacaaaacgaactacgtgacgaagatgtagaaaaaattcttacaacatataaagagcgtaaagacattgataagtatgcccacttagctagttttgatgagattaaagaaaatgaatttaacttaaatattccacgttatgtagacacttttgagcctgaaccagaaattaatttagatgaagtttcaaaagaattaagagaaacgaatgagaaaatcaaagaaaatgaaattgaattaattagtatgctaaaagatttaacttccaaagatgagaagattacgaaaggcttaaatgacttcataagtgtcttagaagaggatgtgaaataa

SEQ ID NO: 240 - protein, 529 aa, Lactobacillus salivarius
MAQEEVTLERSLDNAANVLRSKMDANEYKNYTLGTIFYKYLSDSMLYYVAELLEEKNISLEEAQKLYEENQDDQYLIEELDIKFNYVIEAKNTYTNILKSINNHTFQVSQLGDAFNSIESQGKEFEGLFDDYDLYSKRLGNTAQKQSDTISEVLSAIGKLEIVKTPEDTLGNAYEYLIKQFASESGKKAGEFYTPQKVSRLLARLTLVDKDYTDGMTVYDPTMGSGSLLLNFRKYVEHPKRITYFGQEINTSTYNLARMNMILHHVDVVNQKLRNNDTLDEDWPVEEITNFDAVVMNPPYSHKWSANAGFKDDPRFSAYGVLPPKSKADYAFLLHGYYHLKHSGVMAIVLPHGILFRGAAEGKIRKKLLENGAIDAVIGLPANLFYNTSIPTTIVVLKKDKQDRDVLFIDASKDFEKVKTQNELRDEDVEKILTTYKERKDIDKYAHLASFDEIKENEFNLNIPRYVDTFEPEPEINLDEVSKELRETNEKIKENEIELISMLKDLTSKDEKITKGLNDFISVLEEDVK

SEQ ID NO: 241 - DNA, 1830 bp, Lactobacillus amylovorus
atgaaaaatagcaaaattcaaaagttagctaaagcattacgctcttttagccctcaaccagcacgagcaatccttgctggtgaggcaatcatcaaattggataataaagatctgacttttacttctaagaaggaattgttagagtgcattagatcacattcagaccaatccgttcttatgaataatctaaaaaagtggattataacccaacttaataccgtttccgagaaagatttgttctcaattttaaatctactagccaattattcattgaaagaagtatttaatgctttaaattactttttgatatcgtttccaaatacttcaaaagcctattacaatgatggaagtgccacgggactagatctgctaacaaccgaattagcagatgtcagaaaagacgataaagttttagatccttcatcaggaattaatggagcctggttagaactattgaaaaataatcctaatcaaaatatgacagtacaagaattaaatgaaattgacgcagagtttgcatatttgaatactaaaattctaggtgcgactaattgcatcgtgtatcaaggagatacacttagtgatcctaagtacactcaagatggaaatttacaattattcgataaaatcgtaacattcccaccaatcaacgctaggatctctaaagatgcaatcatagaaaacagatttaatcgctttagatatggagacattacttataccaaaggcgaatctgctttcatcagcaatgcaatctcttcacttaatcaaactggaaaagctgtaattgtagtttccgatggtcctttattccaaggaggtaaagttgcttcattcagaaagttcttagttgatcatgatttgatcgaaacagtaattgcattacccagcagccttttatcatattcaattattcctattaatatcttgatcattaataaaaataaaacagattctaaaggccaaattcagttcatcaatgctaatcagaatgagtggtaccaaactgataaacatggtaaaaggattttatctactctaggaattcagaaaatcgttgaattatatcactccagagcaagtgtagaaggtaaatctgccatttttgcaaatactgattacaaaggtacattaggaattaagcaatacatcttgcctagtgaagtgcaactggacaattctacttatcatattaaccgctcagctttgcaaaacctaaacactgtacagcttcaagagctagttaatatcaagcgaggttacaacgtaaccagaagaaatgaagataaaaaagggcgctatttgaccgctaaagtaacagatatcacaactgaccatcatatcaacgatagcaatctaaccagaataaatatcaagactaatgcagagtcttacttgattgaaaacaacgatattttaatttccactagaggaacaatcggaaaggtggctttcgtaaataatatcaagcaatgtactgtgccaaatgcaaacttagccatcttaagagttaaatctagtaagctaaatacagtcaatatgatttggctaatgctttacttagccagtccattaggccagtttatgattcaacaagttgctactggtactgccatttctacgatttcgactaaagacttaggcaagattcctattccagttttgccgttagaggcgcaaaataaagcagtacagcaatttcaaactgttcaagctaaactaaatgctgaaaaagcagcattacaaaagaagattgaagcaaatcaagaagaattgtattcttctatgaatgtaactaaagttttaagaaaagaaaatacggagaattaa

SEQ ID NO: 242 - protein, 609 aa, Lactobacillus amylovorus
MKNSKIQKLAKALRSFSPQPARAILAGEAIIKLDNKDLTFTSKKELLECIRSHSDQSVLMNNLKKWIITQLNTVSEKDLFSILNLLANYSLKEVFNALNYFLISFPNTSKAYYNDGSATGLDLLTTELADVRKDDKVLDPSSGINGAWLELLKNNPNQNMTVQELNEIDAEFAYLNTKILGATNCIVYQGDTLSDPKYTQDGNLQLFDKIVTFPPINARISKDAIIENRFNRFRYGDITYTKGESAFISNAISSLNQTGKAVIVVSDGPLFQGGKVASFRKFLVDHDLIETVIALPSSLLSYSIIPINILIINKNKTDSKGQIQFINANQNEWYQTDKHGKRILSTLGIQKIVELYHSRASVEGKSAIFANTDYKGTLGIKQYILPSEVQLDNSTYHINRSALQNLNTVQLQELVNIKRGYNVTRRNEDKKGRYLTAKVTDITTDHHINDSNLTRINIKTNAESYLIENNDILISTRGTIGKVAFVNNIKQCTVPNANLAILRVKSSKLNTVNMIWLMLYLASPLGQFMIQQVATGTAISTISTKDLGKIPIPVLPLEAQNKAVQQFQTVQAKLNAEKAALQKKIEANQEELYSSMNVTKVLRKENTEN

SEQ ID NO: 243 - DNA, 1533 bp, Lactobacillus delbrueckii
atggcaaccaaaagtaaagaactgaattttgaagataagttatggaaagctgctgatgcgcttcgtgggaatatggatgcgtcagagtacagaaacgttgtactcggcttaatctttttgaagtacgtatccgatgcctttgaagaaaagcaccaagaattgcttaagtctgatttcccagaggatgctgaggatagggatgcatatgaagcggaaaatattttctggatcccgaagcaagctcggtgggaaaatatcgcaggtgcctcaaagactcagcaaattggcgaagttatcgatcaagccatggaagcaatcgaaaaagaaaacccaagcattcagggtattttgagtaagaactatgaatctcctgatttagataagagtcgcttgggtaaagtggttgacttgatctcggacattgatgtcggtagtaaggaatcccaagatcgggatgtcttgggtagagtttacgaatacttcttgcaacagtttgcttcagctgaaggtaggggtggcggtgaattctatactcctcgctctatcgttaaaactttagtagaaatgattgagccttataaagggcgtgtctatgacccatgctgtggttcaggtgggatgtttgttcagtcagaagaattcgtaaaagaacaccaaggcagaattgacgatttggctgtttatggtgaagaatcaaacccgacaacttggaaattggctaagatgaacttggcgattagaggtattgacaacgacttggggcctcaccaaggtgatacctttgccaatgacatgcacaaaggaacccatttcgattacattcttgcaaatccaccgttcaacattaaggactggggcggtgaaaagcttaaggatgatgcacgttggaagtatggggttccgccggaaagcaacgcaaactatgcttggatggagcacatcattagtaagctgcaaccagatggtaaagcaggttttgttttggcaaacggcgcactttcgacttctcgtaaagaagaattagcaattagaaaagcagttcttgaagatgacaagattgatgcaatcgtagccttgcctgtgcaaatgttctattcaacacagatccctgtttctctttggttcattgacatgaataagttatctgaggatgaacgtgatcgtaagggcgaaacgctttttattgatgccagacaaatgggtgagatgatcgataggacccatagagcatttagtgatgaagatatcaaaaagattgcggacacgtatcatgcttatcgcggcactaacgggcaaaagtatgaagacatacctggcttttgtaaggcagcacacctggatgaaatagtaaaaaatgattacgtacttacgccaggtcgttatgttggacttcctgaggaggaagaagatgatgaaagttacgacgagaagatgacacgcttaacaagtgagcttaaggagcaatttgctgaaagcaacaaacttcaagctgaaatcaaggacgtattaaaggagctggggtatgagatatag

SEQ ID NO: 244 - protein, 510 aa, Lactobacillus delbrueckii
MATKSKELNFEDKLWKAADALRGNMDASEYRNVVLGLIFLKYVSDAFEEKHQELLKSDFPEDAEDRDAYEAENIFWIPKQARWENIAGASKTQQIGEVIDQAMEAIEKENPSIQGILSKNYESPDLDKSRLGKVVDLISDIDVGSKESQDRDVLGRVYEYFLQQFASAEGRGGGEFYTPRSIVKTLVEMIEPYKGRVYDPCCGSGGMFVQSEEFVKEHQGRIDDLAVYGEESNPTTWKLAKMNLAIRGIDNDLGPHQGDTFANDMHKGTHFDYILANPPFNIKDWGGEKLKDDARWKYGVPPESNANYAWMEHIISKLQPDGKAGFVLANGALSTSRKEELAIRKAVLEDDKIDAIVALPVQMFYSTQIPVSLWFIDMNKLSEDERDRKGETLFIDARQMGEMIDRTHRAFSDEDIKKIADTYHAYRGTNGQKYEDIPGFCKAAHLDEIVKNDYVLTPGRYVGLPEEEEDDESYDEKMTRLTSELKEQFAESNKLQAEIKDVLKELGYEI

SEQ ID NO: 245 - DNA, 1800 bp, Lactobacillus kefiranofaciens
atgaataatcagaatgcaaaactaaatgtgctgtatcaagttaatagagatgaagctagtattataaagcctatagtagctggcgaaatacttttaagaataaataaagatgatcgtccaattactaaaaaagtagaattttttagtcgcatattctcttgcaaggataaaagtaatatttttgctcttcaagaacttcaaaactggattaaagatgaattagatgatgttgaagataataagctttttcaaaccttgaattatattagaaaaattagttcacaagatttaattatttggcttaatagcaaggttaaacatagtcgcatagaaagaaggattcagtcttcaaaaatagataggctagctatgaagctggctcttgttaagaggactgatacgatccttgacccaacttcagggtgtgaaggtgcatggctagatattttacgtgaaaataaaaatcaacaggtaactatccaagaaataaatccagtgttggcaggaattgcttatttgaatggcaaactcattaaagcaaataatttgaatattcttgttggagatgttttaaatgatccaaaatacattgaggacggacaattaaaacaatttgataaagtcattagttttccacctatatcgatgataattaattctgaagtcatcaatcaaaatagttttaatcgttttcgttatggaaagattccaagaagaggtgattatgcttttattagtaatgctatttcttcaattgctgataatggtaaagctgttcttttggttgcagatggaccattatttcaatcgggtttagcagctaaaataagaaagaatctcattgatttagatctagttgaagctgttgtttctttgccaagtaaatttttgcttggaacagctattcccgttaatctattaattcttaatagaaataaaggtgcgtttaaaggcaaaattcaatttattgaagctgaccaaaatggttggtatgaaaaagtccttagaaattttaatcaattaacaccattaggaatagaaaaaattgtaagtttgtatcaaaacaaagttgatcaatcaggtgtctcaagagttataaagaattcagaatataaggataccttgagtgttaaaagatatgtgtggccaacttcaatagaaattgatcaaacgacttatagtattagtcagcaaaatttaatggatgcgaagatgatcaatcttggagaattagtggagattaagcgaggctataatgtaattagaagaaatgaaaatggcgatactaccttggcattaataaagatcaccgatatagatgacttagtagtaaaaaataaagctttatctgaaatctcaatatcaagtaatccagatcgatatttagttcgaaagaatgatgttttgttttcaattagaggaacattaggaaaaatagcatatgttgataaatcattaggaaatgctattgctaatgcaaatatggtgattttaaggcccaaaaataataatacaaatatgaaatggctagcgttatatttgaacagtccgttgggtaaattctttattcaacaagcagctggtggaacaacaatttcaattatttctccaactgatttagagcagttgaaagttccagtaattgcaagagaaaagcaagataaagcagttgaaaaacttgaacaggaaaagttaagtttagataagcaaaaacaggaattgatgagaaagtatattcaaaatgataatgaattttttaattcttggggtatggacaaaattttgcataaagaggattaa

SEQ ID NO: 246 - protein, 599 aa, Lactobacillus kefiranofaciens
MNNQNAKLNVLYQVNRDEASIIKPIVAGEILLRINKDDRPITKKVEFFSRIFSCKDKSNIFALQELQNWIKDELDDVEDNKLFQTLNYIRKISSQDLIIWLNSKVKHSRIERRIQSSKIDRLAMKLALVKRTDTILDPTSGCEGAWLDILRENKNQQVTIQEINPVLAGIAYLNGKLIKANNLNILVGDVLNDPKYIEDGQLKQFDKVISFPPISMIINSEVINQNSFNRFRYGKIPRRGDYAFISNAISSIADNGKAVLLVADGPLFQSGLAAKIRKNLIDLDLVEAVVSLPSKFLLGTAIPVNLLILNRNKGAFKGKIQFIEADQNGWYEKVLRNFNQLTPLGIEKIVSLYQNKVDQSGVSRVIKNSEYKDTLSVKRYVWPTSIEIDQTTYSISQQNLMDAKMINLGELVEIKRGYNVIRRNENGDTTLALIKITDIDDLVVKNKALSEISISSNPDRYLVRKNDVLFSIRGTLGKIAYVDKSLGNAIANANMVILRPKNNNTNMKWLALYLNSPLGKFFIQQAAGGTTISIISPTDLEQLKVPVIAREKQDKAVEKLEQEKLSLDKQKQELMRKYIQNDNEFFNSWGMDKILHKED

SEQ ID NO: 247 - DNA, 1524 bp, Lactobacillus salivarius
atggtagaaaaaacaaaagaattaaatattgaacgtgatttgtggcaggctgctgataaattacgtggaagtatggatgaatcagaatatcgtaatgttgtattaggattaatcttcttgaaatatgtatcagattcatttgaagaaaaaagagatgagattttaaactctgattatccagaagaagttgaagaaccagatgcatatttagctgaaaatattttctgggtacctaaagaagctcgttggagtgtaattcaaaaagcagctaaaacaccacaagtcggtgaaattattgataatgcgatggatgctattgaaaaaaataacaattcactccgtggggtattgaataaaaattatgcttctccggatatagataaaactagattaggtggtgtagttgatttagtttcaaatattagtttaaaaggtaatggaaagttagatttactaggtcgagtttatgagtatttcttgaataaatttggttctggaaaaactggtggagaattctatacaccacaatctattgttaaaactttagtagaaatgatcgaaccatacaaaggaagaatttacgatccatgttgtggttctggtggaatgtttgttcaatcaggaaaatttgttcaagaacatcaaggaagaattggggacttatcaatttatggggaagaatccaatcctactacttggaaattagctaagatgaacttagcaattcgtagaatagacaacaatcttggacaacatcaaggtgatacttttactaatgacttacacaaaggtgaaaggtttgattttattttagctaatccaccattcaacattaaagactggagtggtgaaaagctaagagaagatgctcgttggaaatatggtgttccacctgtaggaaatgctaattatgcttggattcaacatattattagtaagttaactccagatggaaaagcaggatttgtccttgctaatggtgcattatctacatctactaaggaagaatatgcaattcgtaaagcgattattgaagatgataagatcgatgctattgttgcaattcctgacaaaatgttctatacaactggtattccagcttctctatggtttattgatatggataaatcttcagataatgaaagaaaaagaaatggtgaaaccttatttattgatgcacgtgaattaggggaaatgttagacagaactcaccgtggattctctgacgaagaagatataaagaaaattgctgatacttatcatgcttatcgtggtacaaatgataaagaatacaaggatatagctggtttttgtaaggtagctaaaattgaagacattgctaaaaatgactatgtcctaactccaggtcgttatgtaggtttagctgaaaaagaagatgatggcgaaccatatgaagtaaagatggaaagattaactagtgaattaaaagaacaatttgaagaaagtaataaattacaagctgaaatcaaagaagttttaaaggagttagggtatgagatatag

SEQ ID NO: 248 - protein, 507 aa, Lactobacillus salivarius
MVEKTKELNIERDLWQAADKLRGSMDESEYRNVVLGLIFLKYVSDSFEEKRDEILNSDYPEEVEEPDAYLAENIFWVPKEARWSVIQKAAKTPQVGEIIDNAMDAIEKNNNSLRGVLNKNYASPDIDKTRLGGVVDLVSNISLKGNGKLDLLGRVYEYFLNKFGSGKTGGEFYTPQSIVKTLVEMIEPYKGRIYDPCCGSGGMFVQSGKFVQEHQGRIGDLSIYGEESNPTTWKLAKMNLAIRRIDNNLGQHQGDTFTNDLHKGERFDFILANPPFNIKDWSGEKLREDARWKYGVPPVGNANYAWIQHIISKLTPDGKAGFVLANGALSTSTKEEYAIRKAIIEDDKIDAIVAIPDKMFYTTGIPASLWFIDMDKSSDNERKRNGETLFIDARELGEMLDRTHRGFSDEEDIKKIADTYHAYRGTNDKEYKDIAGFCKVAKIEDIAKNDYVLTPGRYVGLAEKEDDGEPYEVKMERLTSELKEQFEESNKLQAEIKEVLKELGYEI

SEQ ID NO: 249 - DNA, 2088 bp, Lactobacillus amylovorus
atgccaacaatcgatactacttgggaagaaaaacctgtagatattactaaagaagccaatttcatttggagtattgctaataaaattcgggctgcctacatgcctgataaatacggggatgtaatcatcccaatgaccatcattcgtcgttttgaatgtgcccttgagccaaccaaagaccaagttctagcacaataccaagaaatgcctgaatttccagcaatggctttttatcaaattactggttatcaattttacaacaccagtaagtttgatctcaaagaactatgcaacgaccctgataacattgctgagaactttaaagcctacatttctggcttttctaaggacgtgcaagaaatcctaaagcaattagatatgagtggccagatcgacaaaatgaatgacaacaactgtctatattcagttgttaaagcattctcagaaattgatcttagtgtagaacattttgacagcattaaaatgggctacatttttgaaaatttgattggtcgcttttatcaaaacgttgatgctgggcagttctacactggtcgagacatcattaagctttgtgtatcactacttttagccgagggatgcgatgacatcactgataagaacaaggtaattactgttatcgaccaagcttgtgggactggaggtatgttaagtactgcttacacttacttgaagcactacaatccaactgctgatgtccatctttatggtcaagaaatgatgggacagtcatacgctgtaggattagccgaaatgctcatcaagaaccaaaacatcgacaactttaagatagccgatactctcaaggaagactgcttccctgatcgtaaaatgcgctttgctttagagaacccaccatttggtactccatggggcggcaaagatgctaaggacggtcaagaagatgctgttaaagaagaatacgctaaagggaagaatagccgctggcctgcaggattgcctgcttctggtgattctcaattactgttcttacagtcagcattagctaaattagaggataatggacgtgcagcaatcattgaaaacggatcaccattatttacagggaataccgcctcgggtgaatcacaaattagaagatggctgcttgaaaatgattaccttgaagcaattgtggcgatgcctactgatttgttctacaacacggggatcgctacatacatttggatcctctccaaaaataagagcgaaaaaagacgtggcaaggtgcaactgattgatgccaccaatatctacactaaactacgcaagcccttaggtaacaaaaagaacgaattctccccagaaaacagggcagagattactaaactttatactgatttcagtgaaaatgacctttcacaaatccacgccaataatgaattcatttaccgtgaatacacggtaaagcagccattgcaacgcgattatggtattactgaagcaagaattcaacagatgcttcaatcaacatccgttaaaaacttctatgatgaggctaaggttcaagaactagaaagttctgaaactaaattaaaagcaaaagatgcaaaaaaattagctaaatacaagaagaatgaggctgtttataaacaaatgatgagcatccttaaagaaaacatttcaaataagctatggatgtcgcctgaagaattcgagccagtcctacataatttattagatggcatagttgataaaaagctaatcagtaagattatggatggcttatcccaaatggataaaaaggctgaaattcagcatgatcgtaaaggcaatattgtttacgacaaagaaacagctgatacagaaatcgttaatatagatgagccaattgatgattacatgcaaaaagaagtactaccttttgtgccagatgctaaggctttctttgatgaagatctaggcaaaaagaagcccgtaattaagacaggtgctgaaattccattcactagatacttctataaatatcaaaaaccagaagacagcgagaaactagcaagcgaaattaacaaattagaggcagctatttctgaagaaatggatagcctattcaaaatggaggattag

SEQ ID NO: 250 - protein, 695 aa, Lactobacillus amylovorus
MPTIDTTWEEKPVDITKEANFIWSIANKIRAAYMPDKYGDVIIPMTIIRRFECALEPTKDQVLAQYQEMPEFPAMAFYQITGYQFYNTSKFDLKELCNDPDNIAENFKAYISGFSKDVQEILKQLDMSGQIDKMNDNNCLYSVVKAFSEIDLSVEHFDSIKMGYIFENLIGRFYQNVDAGQFYTGRDIIKLCVSLLLAEGCDDITDKNKVITVIDQACGTGGMLSTAYTYLKHYNPTADVHLYGQEMMGQSYAVGLAEMLIKNQNIDNFKIADTLKEDCFPDRKMRFALENPPFGTPWGGKDAKDGQEDAVKEEYAKGKNSRWPAGLPASGDSQLLFLQSALAKLEDNGRAAIIENGSPLFTGNTASGESQIRRWLLENDYLEAIVAMPTDLFYNTGIATYIWILSKNKSEKRRGKVQLIDATNIYTKLRKPLGNKKNEFSPENRAEITKLYTDFSENDLSQIHANNEFIYREYTVKQPLQRDYGITEARIQQMLQSTSVKNFYDEAKVQELESSETKLKAKDAKKLAKYKKNEAVYKQMMSILKENISNKLWMSPEEFEPVLHNLLDGIVDKKLISKIMDGLSQMDKKAEIQHDRKGNIVYDKETADTEIVNIDEPIDDYMQKEVLPFVPDAKAFFDEDLGKKKPVIKTGAEIPFTRYFYKYQKPEDSEKLASEINKLEAAISEEMDSLFKMED

SEQ ID NO: 251 - DNA, 1440 bp, Lactobacillus delbrueckii
atgattagcaaagaaagaattgatcaaatcagcaaagatatattagagagtagcggatttgcttttgaaaatcgcagtaccgtatttgaactgctggcttacaaaatcctgtctgatcggcaacgagcaatcaagccagtagacgaaaatgaatcaaaagataaaattggctactacattgaaccaaactattcgtttgagaaggttgctcaaagagatcgcacaaatccagaaagttggtatgaagcatttcagaaattcgcagttaccaacccactacttttagatatgttcacctcagagtatccgcatcttggtgaaattaaagataagtcattagaagactaccttacgacttgcgacttcacgggattttctgtaactgaatcaagtttcttatttgatgaattgttggaaaattgctattcggatcacagaatgctgtattcaggtgatgcccctaaacagatgagaaaactaattgccgagattttgaacagtgaggttaagacggagaaggtatcaatatttgatcctgtagcaatgtctggatcactcttgctcactctgaaagagaagttccaaagtaaagtggaactatatggtgaagaattttcttcagatctatttcggttattaaaaatgaatatggtgattcatgggatagatatccaaacaattcatgataacttcgtgaggggagactttcttaaagacgaagagtttgacgcaaacagtaagtttgacataatcccaatgacaccgccattttcaagttgggatgcagatccagagttactgaatgatccctgcttctctgaggttggagtgttacctcccaagtctaaagctgattacgcatatgtgttgaggggattacaacatctgagtgaagatggaactatggctgtaatgttaccaactggcgcactgtttagatcagccactgaaggtgaaattcgaaaataccttttagaaaagcaaaatatacatgcagtaatttcactaccacaaggtgcacgtaattatatggctatctataccgtgttgcttatcttcaagcaaaagaagtcagacaagatcttatttattgatgcaagtcgagatggagtaaagaacgctactcgcttaaaacagaatttccttaccgaggaaggatttactaagatactgcatatttaccgcaaccgagaagaagtagatcgttattcaagattggtcagcttagatgaaattcgtgagaacgactataatttgaacattccacgttatatcgacacgttctcagagaaaaagatcgatgttgaagcaacgatatcatccttgtcagctaagcagagagtaattgaaaagagtaagaaggaaatgatcgagctgctgaataagtttgatactccagaagcccgtcaagctatcaaagctgtaagtatctctgaataa

SEQ ID NO: 252 - protein, 479 aa, Lactobacillus delbrueckii
MISKERIDQISKDILESSGFAFENRSTVFELLAYKILSDRQRAIKPVDENESKDKIGYYIEPNYSFEKVAQRDRTNPESWYEAFQKFAVTNPLLLDMFTSEYPHLGEIKDKSLEDYLTTCDFTGFSVTESSFLFDELLENCYSDHRMLYSGDAPKQMRKLIAEILNSEVKTEKVSIFDPVAMSGSLLLTLKEKFQSKVELYGEEFSSDLFRLLKMNMVIHGIDIQTIHDNFVRGDFLKDEEFDANSKFDIIPMTPPFSSWDADPELLNDPCFSEVGVLPPKSKADYAYVLRGLQHLSEDGTMAVMLPTGALFRSATEGEIRKYLLEKQNIHAVISLPQGARNYMAIYTVLLIFKQKKSDKILFIDASRDGVKNATRLKQNFLTEEGFTKILHIYRNREEVDRYSRLVSLDEIRENDYNLNIPRYIDTFSEKKIDVEATISSLSAKQRVIEKSKKEMIELLNKFDTPEARQAIKAVSISE

SEQ ID NO: 253 - DNA, 1476 bp, Lactobacillus kefiranofaciens
atggtaggaacaactcaatttgtaaaaaagattagagatattatgcgtaatgatccggggattaacggtgatgcgcagagaatcgaacaattatcatggattttgtttttgaaagtttatgatgatcgtgaaaaagtgtgggaaattgaacaggatgattatgagtctatcattccggaagggatgcattggcatgaatgggctcaagatagaaaagatggtaaagcgttaactagtgatgaattactagattttattaataatcaattgttacctacattaaaggagattactgttactcccgatactcctattagtaaggctattgtgaaagatgcctttattgataccaataactatatgaaaaatggggttttattacgacaagttataaatgtagtaaatgatgtagattttactgatcctaaagatcgtcatttatttggtgacatttatgagagtatcttaaaggaattgcaaagtgccggtagttctggtgagttctatactcctagggctctgactgattttattgctgaaacgttgaagccaaaattaggacagcggattgcggatttagcttgtggtacaggtggattccttgttagctcgttaaatattttaaagaagcaagtaaatacagtagaagatcgaaaaaagtataataatgcggtctttggtattgaaaagaagggacaaccatatattcttgcggtaactaacttattgcttcatgatgttgataatcctgatattattcatggcaattcgcttgaaaaaaatattaccgaatatactgaaaaagataaatttgatctgattatgatgaatccgccttttggtggctccgaattgcccattatcaaaaagaattttcctagtgatcttcaaagtagtgaaacagcagatttgttcttagctttgattatgtatcgtcttaaagatgatggtaaagttggtgtgattcttccagatggtttcttgtttggaaatgatggagctaagttaaatatcaagaaaaagatgctttctgattttaatttacatactattattcgtttaccaagtagtatttttagtccttatgcttcaattgccacaaatattttattctttgataagactggcccaactaaacaaacttggttctaccgtttagatatgccagaaggatataaacatttttctaagactcgtccaatgaagctcgaacattttgatccagtacgtaaatggtggaatgaccgtcacgagattaaagatgataatgataattacaaatcaaaagcttatacaccagaagaattagcaaaaaataactataactttgatttatgtggcttttcaactgaaactgaagaaatattaccaccatttgaattaatgaataaatatcaaaaagaacgtaaagaattaaatgccaagattgataaacaattggcagcaattaaaaagttacttgaggaggatgattaa

SEQ ID NO: 254 - protein, 491 aa, Lactobacillus kefiranofaciens
MVGTTQFVKKIRDIMRNDPGINGDAQRIEQLSWILFLKVYDDREKVWEIEQDDYESIIPEGMHWHEWAQDRKDGKALTSDELLDFINNQLLPTLKEITVTPDTPISKAIVKDAFIDTNNYMKNGVLLRQVINVVNDVDFTDPKDRHLFGDIYESILKELQSAGSSGEFYTPRALTDFIAETLKPKLGQRIADLACGTGGFLVSSLNILKKQVNTVEDRKKYNNAVFGIEKKGQPYILAVTNLLLHDVDNPDIIHGNSLEKNITEYTEKDKFDLIMMNPPFGGSELPIIKKNFPSDLQSSETADLFLALIMYRLKDDGKVGVILPDGFLFGNDGAKLNIKKKMLSDFNLHTIIRLPSSIFSPYASIATNILFFDKTGPTKQTWFYRLDMPEGYKHFSKTRPMKLEHFDPVRKWWNDRHEIKDDNDNYKSKAYTPEELAKNNYNFDLCGFSTETEEILPPFELMNKYQKERKELNAKIDKQLAAIKKLLEEDD

SEQ ID NO: 255 - DNA, 1416 bp, Lactobacillus salivarius
atggataaagaattggaaaatagattatcagttaatgattttgaaataagtaacgaagaatatatgattaaaatagctttctatctagaaatttctaaaaaggcattaagagcttttgattctactgaagatattttagaagttcaaaaacaatatgaaatgagcgatggtacagataaaaatacacagttagtgattgatcctaaagatacatactatcatcattatctattatataaggatagaaaatttaaatatgaagatcttataaaatctctctataatgtagaaaagaaaaatcctattttaaaaaatatgtttaaagatattaaaggaagcaacatggaaggacgtgtagctgatttgatattcgctatgatgtatctgaaaaaggagccaagttttgaagaactattagactggattgcaagaagttctggatcaagatcagaatttagttttacaccactaagtatcaataaattaatggtaaagctagttggttcttttaaagaaaatattacagtgtatgatccagctgtaggtacagcaaatttattattaaatgtagatagtgaaaatttcgaaaagaataaatattatggacaagatattaataaatttgtgttagaaattgctaaaatgaatgctatcttacaagatataaatagtaagaacattgaattaagattaggtgattcattaaatagtaattggaattttggcaaggctgatgttgtagtagctgatatgccattagcgatgagttggagaccaagtaaagacttagaacaagatgatcgctataaaaattatggaaaactccctaataaaaatgaatggccatttattttagaaggtttagataaattatcagatgatggtacgatgatagcactatcagctcaagggattttatttagagctgctaaagaatataaggttagacgaaaacttttagaagatggaatgataaaagcagttatcctattaccagaaaaactttattatggaacaagcgtagcaacctgtttattagtacttaaaaagtcatctaaagacagagatgtattcttcattaatgcaagtaaggaatatcagaaagtaaaatcaaataacgttttaacagatgataatattggaaagattgtagatacatttaacaatcaaaaagaagtaaaaaatttctctcgtaaaatatcttttgaagaaatacaaaaaaatgattttaatttaacaatggctcgctatattaatcaatatcaatttcaagaaaagctaaatcaacaaaaagaatttgaaaatttgacaaagattgataataagataggcaatgttgatgaggaactaaataaaataatgagggaactagtaactgacgataaattaaaggaagtagagaaattaattaagtaa

SEQ ID NO: 256 - protein, 471 aa, Lactobacillus salivarius
MDKELENRLSVNDFEISNEEYMIKIAFYLEISKKALRAFDSTEDILEVQKQYEMSDGTDKNTQLVIDPKDTYYHHYLLYKDRKFKYEDLIKSLYNVEKKNPILKNMFKDIKGSNMEGRVADLIFAMMYLKKEPSFEELLDWIARSSGSRSEFSFTPLSINKLMVKLVGSFKENITVYDPAVGTANLLLNVDSENFEKNKYYGQDINKFVLEIAKMNAILQDINSKNIELRLGDSLNSNWNFGKADVVVADMPLAMSWRPSKDLEQDDRYKNYGKLPNKNEWPFILEGLDKLSDDGTMIALSAQGILFRAAKEYKVRRKLLEDGMIKAVILLPEKLYYGTSVATCLLVLKKSSKDRDVFFINASKEYQKVKSNNVLTDDNIGKIVDTFNNQKEVKNFSRKISFEEIQKNDFNLTMARYINQYQFQEKLNQQKEFENLTKIDNKIGNVDEELNKIMRELVTDDKLKEVEKLIK

SEQ ID NO: 257 - DNA, 1803 bp, Lactobacillus delbrueckii
atgcatcgtttattggttttacgggtacgccaatcgatatggccgataaatcaactacagctgtttttggtaactatatcgatgtttacgatattactcacagcagttaaagaccatgcgactgtcaagatctactacgaaagtcatgttttcccacttgcgattaagaaagaagaccaggaaaagctggccaagcttattaatgagagtggcatcgatgatgatccaaatctgccacagaatgaacgtcgcaagcgagaaatgactcgtattcaaacgcttgcgggcgctaagtctcgtcttcaagcaattgcaaagcacttcgttaagcactttgaaactcgccgaaagtcggcttttgggaaatctatcatcgtagaaaattcgcggactaatgccgttcgactgtatgatgaaattatcaagctaagaccagaatggcacgatgatgatcttaacaaagggaagattaagatcgtgatgactacaaacgcttccgatggcccggaagttgcaagattcaagactactaagttgcaacgacaagctttacaacatcggatgaaggataacgatgacgagcttcagattgtcattgttgttgacatgtggctgacaggctttgatgtgccaagcttaaataccatgtatattgacaagcctatgcatggacataacttaattcaagcaatcgcccgggtcaatcgcgtcttcaaagacaaggatagtggcctaattgttgactacattggtattgcggagtccttgagccaagcattacggaagtattcgaagaatgaccaagggcaagtcggaataaatatatctaaggccttatctttgctgaaggataagtataacattatcaaaaatgacttcctgtatggtgttaattacaaagggtttgactcagatgataagaccatccggattaaagttgtttcgaaagtcgcaaatgaattactatcagaaagtgaagatgaccagcaaaagttccttacaactgtttctcaagcacaaagactatatgccttggtagctatccaaaaagaagctcaagagttagcacctgaaattgcattttttggtgcagtaaaggtgttcctaattaaaattaagtcaaatagttcagatccagatcgtccagatataatcgaagtcgattatcgtcttctgcaactgatagaccagtcaatcatcacagaaccggaggttgacatctacaaagacttaggtttcgaaagaccaagtttggacttgatttcggatgaatttttgcaaaaagtttctgagatggaggagaaggacttagctattaatatcttggaaaagatacttaaagccaaggttaagttgataaagtcaaccaacgttgtgcaaggtagaaaattccaagaaatgctagaaaactccatcaaagaatataatttgcgtggtattactagtgaaatcgtgatccgtaaattgatcgaaatggctcaagaaattaataaggagcagcagaaggggaaagacttaggtctctcacctgaagaaatcgctttctatgatgccttggcaaaccgcgaaaaggctgttcagatgcttggtgaggaaactttacataagattgctcatgaattagtaaagaccgttagagccaatgcaggggttgactggtctagacgtaagaatgttcaagccaagatgagaatggcggtcaaacgactgttacgtaagtatggttatccgccggactttgcaagtgaagccgttgacaatgttttggaacaagctgagcggatggccgctaacgagtcatag

SEQ ID NO: 258 - protein, 600 aa, Lactobacillus delbrueckii
MHRLLVLRVRQSIWPINQLQLFLVTISMFTILLTAVKDHATVKIYYESHVFPLAIKKEDQEKLAKLINESGIDDDPNLPQNERRKREMTRIQTLAGAKSRLQAIAKHFVKHFETRRKSAFGKSIIVENSRTNAVRLYDEIIKLRPEWHDDDLNKGKIKIVMTTNASDGPEVARFKTTKLQRQALQHRMKDNDDELQIVIVVDMWLTGFDVPSLNTMYIDKPMHGHNLIQAIARVNRVFKDKDSGLIVDYIGIAESLSQALRKYSKNDQGQVGINISKALSLLKDKYNIIKNDFLYGVNYKGFDSDDKTIRIKVVSKVANELLSESEDDQQKFLTTVSQAQRLYALVAIQKEAQELAPEIAFFGAVKVFLIKIKSNSSDPDRPDIIEVDYRLLQLIDQSIITEPEVDIYKDLGFERPSLDLISDEFLQKVSEMEEKDLAINILEKILKAKVKLIKSTNVVQGRKFQEMLENSIKEYNLRGITSEIVIRKLIEMAQEINKEQQKGKDLGLSPEEIAFYDALANREKAVQMLGEETLHKIAHELVKTVRANAGVDWSRRKNVQAKMRMAVKRLLRKYGYPPDFASEAVDNVLEQAERMAANES

SEQ ID NO: 259 - DNA, 3045 bp, Lactobacillus kefiranofaciens
gtggaacaagaagcagtaattgaagaaaaattaattaatcaacttacacgtaaagattcaaagtggacacttcgtgaagatttaaaaaacgaagatgatctttgggataacctctttaaaattttgtcacgaagtaataaggatgttctgaaggatgtcccactgactgataatgaaaaagcagtaatcaagtcaaaaattattcagccaactttttacaaagcagcagaatggttagctggcgttaatggacagattagactagcaattcaacgagataatactaagttaggtactgcagactttttagtaattaataataatgatattgctggtggtaactcaacgtatgaagttgttcatcaaattcaattccataagcgtagagaaattgaccgtaatcgtcgtggggatgttactcttttaatcaatggcttgccaatgattcatatcgaattgaagaatagggcacattcacctaaggaagcatttaatcaaatccaaaaatatattgatgagcagatgttcaatgggattttttcaacgattcaaatgtttgttgtttctaatggaagctacactcaatatattgcggcaggtcagcaattaagagaaaagttcttaactacttgggtagataagaataataagccagttcagaattacttagattttgctagagaagtattgtctattccagcagctcatcatatggtggctgattacattgtcttagatagcattcaacatagtatcattgtgcttcgtccctatcagattcacgctattcaggcaattgaacgtgcttcgttaggaataaaaataatagatggtaaagaaaaaagagaggaaccatattctggttttgtttggcatactacaggttcaggtaagacgttaacttcgtataaagttgctcataatttacttaagattccatcaattgaaaaaacggttttcttaattgatcgtaatgatcttgatactcagacttcgcaagcctttgaaacttatgctcagaatgattcaattgaagttgaaagtacggaaaacagttatgtcttagctagaaaactaacatcatcagacaagaaagtagttgttactactcgtcaaaagatgcaagctttattcaaacgaatcaagcaagatcaagagcaaaagcgtttatataagaaattaaagaatgtaaaactagctttcatcgttgatgaatgtcaccgagcagtttccccagatcagaagaatgaaattgatgctttctttgctaaacatcctttgtggtatggttttactggtaccccaatatttgatgaaaatgctagagaagctaaggggaggaatgctcgtactacggaacagcagtacggtaaatgcttacataaatatacaattaaagatgccattagagataaggctgtcttgggcttccaagttgaagaagaaggaagtaattctgtcaatacggatgaatctgatatagatgcaagaaagaaggaatatttatctctttctcatatgaaagctgtggtcaagcgagttatcgaaaactcttatcgtaagctaggtatctacaacaagaacagtcgtggttactcctatgatgcaatttttacaactagttctattaagcaagctcagaagtattaccgtatttttagggatgtgattaatggaactgatccagatattcagattccttcatatattaaaaaggtgttacctgattttcctaaagtagcgattacttattcagttggtgaaaatggcgatggagatgaagctaatcaaaaagaaatgaaacgatccattgaagattataataatatgtttgatacacattattcaatggaggaattagctgcttacaatactaatgtcaatgatcgtcttgctcgcaaaaaagctgaatttaagccgagagtacaacaattagatattgtgatcgtagttgatcgtttactaaccggctttgatgcaccatgtttgtccactttatttattgatcgaccaccgatgtcatacaaggacttgattcaagcattctctagaactaatcgaattttcgataaggataaaaaatatggtcaagtagtgacgtatcagtatcctaagaaatttgaagctgatatcaatgctgccatagcgctttacacagaaggcggaagtagtgagattctagctccaacttgggatgaatcaattattaaatttaaaaaggctgaaaaacaaattattaaatatgataatcatcaaggtataccaattgcggaggcaccattagagcaacaaaagcgctttttgaaagaatatcaagaatttgataaaagcttaggtgcaattaagacttataacgagtttagtgatattgatcttgaaaaagattatggcttgaacacttcgtttatcgaagacacgcgtgctacctatgaagtagtgaaagagcaagttagggaagcaactggtggtaatgatggagatggacaggatgcagatgatcaatttgatccagaatatgaattagaaaatactggaagacaggaaattaattacgcttatattgttcaattgattcaggcttatattccttcagatactgagataggaactcagagaactgaagctgaagttaaagaaattgatgactatatcaagaatctaagtgaaaataataaagcattggctgatatcatgcaaaatctttggtttgaaattaagtttgatcctgaaaaatttagaaacaaacaggtcaatgagcttctacaagggatgattgatgatgcaagggaggacttaattaagaactttgctaatgataatggattaaatattgatgacttaaagtttgtaattcgtcattatgatccgaatgaagatagacagcaaacagggattaatactttgctatcatttagtgtgtttaagaacttccggcagttgcatccagatactgagctgaatatgttgcaatggaaaaagaacgttcgtgaagggctcaaaaagttttatgaagatgagatttctcctttagatgagcaagaatag

SEQ ID NO: 260 - protein, 1014 aa, Lactobacillus kefiranofaciens
MEQEAVIEEKLINQLTRKDSKWTLREDLKNEDDLWDNLFKILSRSNKDVLKDVPLTDNEKAVIKSKIIQPTFYKAAEWLAGVNGQIRLAIQRDNTKLGTADFLVINNNDIAGGNSTYEVVHQIQFHKRREIDRNRRGDVTLLINGLPMIHIELKNRAHSPKEAFNQIQKYIDEQMFNGIFSTIQMFVVSNGSYTQYIAAGQQLREKFLTTWVDKNNKPVQNYLDFAREVLSIPAAHHMVADYIVLDSIQHSIIVLRPYQIHAIQAIERASLGIKIIDGKEKREEPYSGFVWHTTGSGKTLTSYKVAHNLLKIPSIEKTVFLIDRNDLDTQTSQAFETYAQNDSIEVESTENSYVLARKLTSSDKKVVVTTRQKMQALFKRIKQDQEQKRLYKKLKNVKLAFIVDECHRAVSPDQKNEIDAFFAKHPLWYGFTGTPIFDENAREAKGRNARTTEQQYGKCLHKYTIKDAIRDKAVLGFQVEEEGSNSVNTDESDIDARKKEYLSLSHMKAVVKRVIENSYRKLGIYNKNSRGYSYDAIFTTSSIKQAQKYYRIFRDVINGTDPDIQIPSYIKKVLPDFPKVAITYSVGENGDGDEANQKEMKRSIEDYNNMFDTHYSMEELAAYNTNVNDRLARKKAEFKPRVQQLDIVIVVDRLLTGFDAPCLSTLFIDRPPMSYKDLIQAFSRTNRIFDKDKKYGQVVTYQYPKKFEADINAAIALYTEGGSSEILAPTWDESIIKFKKAEKQIIKYDNHQGIPIAEAPLEQQKRFLKEYQEFDKSLGAIKTYNEFSDIDLEKDYGLNTSFIEDTRATYEVVKEQVREATGGNDGDGQDADDQFDPEYELENTGRQEINYAYIVQLIQAYIPSDTEIGTQRTEAEVKEIDDYIKNLSENNKALADIMQNLWFEIKFDPEKFRNKQVNELLQGMIDDAREDLIKNFANDNGLNIDDLKFVIRHYDPNEDRQQTGINTLLSFSVFKNFRQLHPDTELNMLQWKKNVREGLKKFYEDEISPLDEQE

SEQ ID NO: 261 - DNA, 549 bp, Lactobacillus delbrueckii
ttgtcatacattgatgagagagacgtcgaaaacttgacattagaagaattagccgaggagggctacacggtacttaagagtgatagctatactgagcctaatgttgaggttgacgcagaacgtcaaaatgaccacaccaaggttattcttgaaggtcggctcatgtctgctttgaaaagattcaaccctggttatgacgatgaaatctatagactggctttacgccagttcaaaattctggctgatagcccggatatcatgatcaataaccactatttacataatttgctagttggtggcgcaaaggttaaaactgttgataagggtgaagacaggaccataactctttatccaattaattttagaaattggcaggataacgattttttggcgaccaatcaatttacggttaaccagggtgatcatgagcgccggccagacgtaaccatttttgtcaatggattgccactggtgacttttgaattgaaaaatgctgataattcccaacgttggtgtgagagaaggattcgctcaacttgggacatataa

SEQ ID NO: 262 - protein, 182 aa, Lactobacillus delbrueckii
MSYIDERDVENLTLEELAEEGYTVLKSDSYTEPNVEVDAERQNDHTKVILEGRLMSALKRFNPGYDDEIYRLALRQFKILADSPDIMINNHYLHNLLVGGAKVKTVDKGEDRTITLYPINFRNWQDNDFLATNQFTVNQGDHERRPDVTIFVNGLPLVTFELKNADNSQRWCERRIRSTWDI

SEQ ID NO: 263 - DNA, 1485 bp, Lactobacillus acidophilus
atgactcctgaacaattaagagcttcaattcttcaatatgcaatggaaggtaagttggttaagcaaaattttgatgatgagccagctagtaaattaattaagaaaatagaagatgaaaagcttcaattagttaaagaaggtaaaattaagaaaggtaaaaagttaccagcaattactgatgaggagaagccgtttgatattccaaataactgggaatgggttaagctaggaaacattgttgattatgttcaaagagggaaatctcctaaatatgataaagaatctaatagttatccaattatttctcagaaatgtgttcaatgggatggtgtacatcttgaatttgccaaacatctaaaagaagacttttggaaagaattaccttcctatagatttgttactaagggagatcttcttttgaattctactggtactggcacggtgggcagaattattaaagttacagaatcatttgataaaattccagtagattcacatgtgactataatcagattaaacaaaaatgtatgtaatagctatattctatattttttaatgtctccaattatccaaaataatttggatgattatttaactggtactaccaaacaaaaggaatttggcttagcttctattcaaaatatcgttatatctattccaccattagaagaacaaaaacgtattgtagcaaaaattgaaaaattaatgcctttggtggatgaatatgctgaatcatataatcgtcttcaaaagattgataatgaatttgaagataaattaaagcaatctgtcttgcagtatgccatggaaggtaagctggttaaacaaaatcctagtgatgaaccagccagtgaattaatcaagaagattgaaaatgaaaaagccgaattagtcaaagaaggaaagattaagaagagcaagaagttacctgcaattactgatgatgaaaagccgtttgatattcctaatagctgggaatgggtaagattaggagatatagtacaagcacaaattggtaaaacacctcaacggcataactctgattattgggcagaaagagatataccttgggtttcaatatctgatttgacaaacggaaatctgacagaaactaaggaaaagatatcttcgaaggctttaaaggatgtttttcatgatcgtattgtagctaagaatactttgctaatgagttttaaactaactattggtaaagtagcaatattacgaataaatgcagttcataatgaagctatagtttctattatcccatttatagatagtgagcatagtttaagagattaccttttcgttaccttaccaatgataagtcaaaatggtgatttcaaagatgcaattaaggggaagactttaaataaaagctcgttaactaaattacttattcctttaccaccattaaaagaacaaaaacggattgtagcaaagcttagagaatttaaaagatcagcagatattttgtctaaatag

SEQ ID NO: 264 - protein, 494 aa, Lactobacillus acidophilus
MTPEQLRASILQYAMEGKLVKQNFDDEPASKLIKKIEDEKLQLVKEGKIKKGKKLPAITDEEKPFDIPNNWEWVKLGNIVDYVQRGKSPKYDKESNSYPIISQKCVQWDGVHLEFAKHLKEDFWKELPSYRFVTKGDLLLNSTGTGTVGRIIKVTESFDKIPVDSHVTIIRLNKNVCNSYILYFLMSPIIQNNLDDYLTGTTKQKEFGLASIQNIVISIPPLEEQKRIVAKIEKLMPLVDEYAESYNRLQKIDNEFEDKLKQSVLQYAMEGKLVKQNPSDEPASELIKKIENEKAELVKEGKIKKSKKLPAITDDEKPFDIPNSWEWVRLGDIVQAQIGKTPQRHNSDYWAERDIPWVSISDLTNGNLTETKEKISSKALKDVFHDRIVAKNTLLMSFKLTIGKVAILRINAVHNEAIVSIIPFIDSEHSLRDYLFVTLPMISQNGDFKDAIKGKTLNKSSLTKLLIPLPPLKEQKRIVAKLREFKRSADILSK

SEQ ID NO: 265 - DNA, 1278 bp, Lactobacillus amylovorus
atgactaattctaaattaaaggattcaaatattgaatggttaggaaaaataccaagtaattggaaagtaaagccattgtatttatttttctttgaacgaaaaaataaaaataataaaggaaaagaaaagaatttgctttccttaagttatggaaagattattcaaaaagacattaattcaactggtggcttacttccacaaagttacaatacatataatgttattgaagctggagatattattataagaccaaccgatttacaaaatgataaacatagcttaagaacagctttctcgaaagaacatggtattattacttcagcatatatagacttagcaccattaaaagatactaacagcgagtattttcactacgttttacatgcatatgacattgaaaaggtcttttataacatggggaatggggttcgacaaggcttaaattatagtgaattttccaaactcaaactgcctattccttcatcagaagaacaaaaagaaattgttaatttcttgaataaccaagtatctcaaatagataagctctctaaaaaaattcagcaagaaatcattgacttagaagaatatcgaaaatcaattattactaaagccgttactaagggattaaatccaaatgttccaatgaaagatagtggcatcccttggatcggaaaaataccccaaaattggaaaattatcaaaggaaaatacttattcagattattatccaaacctgttaaaaaagatgaccaagtcataacatgttttagagatggccaagttacactacgtgtaaaacgcagaacaactggatttaccatgtcagatcaagaaataggatatcaaggtattgataaaggtgatcttgtagttcatggaatggatggttttgctggggcaataggaatttctgattctagaggtaaaggttcacctgttctcaacgttttagattctaatcaagataaaaaatatatgatgtactgcttacgagcaactgctcaattaggggtttttcaggcattagctaaaggtattagagtaagatcagcagatactcgttggccaactttagcaaatttaaaatatgcaatcccaccacagtcagaacaagctaatgttgttaattatttatcaaataattcctacaaattaaacgcaattattcaagccaaaaaagatttagtagaaaaattgaatcaatacaagcaatcaattatctatgagtacgttactggtaagaaacaagttccaactgaagaaggtgcagtagaatga

SEQ ID NO: 266 - protein, 425 aa, Lactobacillus amylovorus
MTNSKLKDSNIEWLGKIPSNWKVKPLYLFFFERKNKNNKGKEKNLLSLSYGKIIQKDINSTGGLLPQSYNTYNVIEAGDIIIRPTDLQNDKHSLRTAFSKEHGIITSAYIDLAPLKDTNSEYFHYVLHAYDIEKVFYNMGNGVRQGLNYSEFSKLKLPIPSSEEQKEIVNFLNNQVSQIDKLSKKIQQEIIDLEEYRKSIITKAVTKGLNPNVPMKDSGIPWIGKIPQNWKIIKGKYLFRLLSKPVKKDDQVITCFRDGQVTLRVKRRTTGFTMSDQEIGYQGIDKGDLVVHGMDGFAGAIGISDSRGKGSPVLNVLDSNQDKKYMMYCLRATAQLGVFQALAKGIRVRSADTRWPTLANLKYAIPPQSEQANVVNYLSNNSYKLNAIIQAKKDLVEKLNQYKQSIIYEYVTGKKQVPTEEGAVE

SEQ ID NO: 267 - DNA, 480 bp, Lactobacillus brevis
atgcctaaaactattagagaacttgctgatgaatttgatgtatcaaaacaggccattaggaaaaagctcgatgcaaactttagagcaaactatgtacaaactgtgactaggaacggagtacaaacgttagttattaccaattcaggttatttgctgttaaaacaacattttagtagtggtaacaaccagaaaccagatggaggaacatttactagtaacactggtaacaggaatcaagatacaataaaattactcaaccaacaattaacgatcaaagatagtcaaattaaagaaaaagatgcacaattaaaatcaatgcaaaaattattagatcaatcacaacaattgcaactaatggctgagaaaaaaattgaagaatttaaatcaattactcttaaaaaagatgactttactccctccaatccagaaagtgaagataatacttcaaacaccaaaaatgcttggtggcatttttggtaa

SEQ ID NO: 268 - protein, 159 aa, Lactobacillus brevis
MPKTIRELADEFDVSKQAIRKKLDANFRANYVQTVTRNGVQTLVITNSGYLLLKQHFSSGNNQKPDGGTFTSNTGNRNQDTIKLLNQQLTIKDSQIKEKDAQLKSMQKLLDQSQQLQLMAEKKIEEFKSITLKKDDFTPSNPESEDNTSNTKNAWWHFW

SEQ ID NO: 269 - DNA, 627 bp, Lactobacillus casei
atgaaagatcaacaagctagttacccgcagttaagatttaaagggtttactgatccttgggaagagcgtaagttatctagcatctcagagcgtgttactagaaaaaacaaaaataatgagtcgactcttccgctaacaatatctgcacaagatggtttggtagatcaaaatgattttttcaataagcaagtagcgagtcgtgatgttactggatattttttagttaaaaatggtgagtttgcatataataaaagttattcaaatggatatccatggggcgctattaagcgtttagataagtatgatatgggcgttctatcgacactttatatagtctttagacctacgaaaatcaattctcagtttctagtttcatattacgataccactagatggtaccgggaggtttctaagaatgcggcagaaggggctcgtaatcatgggttactaaatattgcacctactgatttttttaatactctactagttgttcctaagatagtagatgaacaacaaaaaatcggctcatttttcaaacagttagacgacactatcgctcttcatcagcgtaagcttgaaaaactccaagaacttaaaaaagggtatctacaaaagatgttttgctga

SEQ ID NO: 270 - protein, 208 aa, Lactobacillus casei
MKDQQASYPQLRFKGFTDPWEERKLSSISERVTRKNKNNESTLPLTISAQDGLVDQNDFFNKQVASRDVTGYFLVKNGEFAYNKSYSNGYPWGAIKRLDKYDMGVLSTLYIVFRPTKINSQFLVSYYDTTRWYREVSKNAAEGARNHGLLNIAPTDFFNTLLVVPKIVDEQQKIGSFFKQLDDTIALHQRKLEKLQELKKGYLQKMFC

SEQ ID NO: 271 - DNA, 627 bp, Lactobacillus casei; identical to SEQ ID NO: 269

SEQ ID NO: 272 - protein, 208 aa, Lactobacillus casei; identical to SEQ ID NO: 270

SEQ ID NO: 273 - DNA, 1188 bp, Lactobacillus coryniformis
atgatcagtcaaaaccggaggctcacaatgaaagataaccaagttaaatatccgcaattaagatttaaaggtttcactgatccttgggaacagcgtaagctatgcgatttgggatcggttgcgatgaacaagcgtatcttcaaagaacaaacgagcgatacaggtgatgttccattttataaaattggtacatttggtggaacgccggacgcattcatcagtcgagacttatttgaagaatacaagtcaaagtatcaataccctgaagtgggtgatattctaatttccgcatcagggagcattggccgaactgttgtctatcggggcgctgacgagtattttcaagactcgaatattgtctggttgaaacacgactcgcagttagtgaactcatttttaaagcagttctattcaattgtgaagtggcaaggtcttgaaggtagcaccatcaagcgactatataataaaaatattttagaaacaccaattacactaccctcaccggaagaacaaaccaagttgggtgaattctttgaaaagctcgataaccttatcgctgctaaccagcgtaagttagatttgcttaaggaacagaaaaaaggctacttgcaaaaaatgtttcctaaaaatggtgcaaaagttcctgaattgcgatttgcagggtttgctgacgattgggaagagcgtaagttgggagaggtttcaaatataaaaacggggtctagtgacctacaagatgccacagataatggggaatatcctttttttgtgagatctgaaaagattgagcgaagccatcggtatcttttcgatggtgaggctattttaattccaggcgaaggtcgtcttggagaaatataccactatattaatgggaaatttgactttcaccagcgcgtttataaaataagtaatttcactgattttaaagtatctggaatgtacattctgtattacatgcagcataactttaaacgacatgcgctgaaatttacagtgaaggcgacagtagattcattacgattacctatgcttaccgactttgatataaaaataccccttgaagaagaacagactaagattggttcatttttcaaacagttagataatactatcgctcttcatcagcgtaagcttgaaaaactccaagaacttaaaaaagggtatctacaaaagatgttttgctga

SEQ ID NO: 274 - protein, 395 aa, Lactobacillus coryniformis
MISQNRRLTMKDNQVKYPQLRFKGFTDPWEQRKLCDLGSVAMNKRIFKEQTSDTGDVPFYKIGTFGGTPDAFISRDLFEEYKSKYQYPEVGDILISASGSIGRTVVYRGADEYFQDSNIVWLKHDSQLVNSFLKQFYSIVKWQGLEGSTIKRLYNKNILETPITLPSPEEQTKLGEFFEKLDNLIAANQRKLDLLKEQKKGYLQKMFPKNGAKVPELRFAGFADDWEERKLGEVSNIKTGSSDLQDATDNGEYPFFVRSEKIERSHRYLFDGEAILIPGEGRLGEIYHYINGKFDFHQRVYKISNFTDFKVSGMYILYYMQHNFKRHALKFTVKATVDSLRLPMLTDFDIKIPLEEEQTKIGSFFKQLDNTIALHQRKLEKLQELKKGYLQKMFC

SEQ ID NO: 275 - DNA, 903 bp, Lactobacillus coryniformis
ttacccaaatttttatattacatttcaatatcagatgactttcgtcagatggctattcaatcaatgactggcacatcagggcgtcagcgtgttcaaagcgaatcagttattaactatgaattttccctaccagacatagagaaacaaacagcaattgtagacttgttagatgccattgatcaaaaattgaaaatcaatcagcagattaacaaaaacttgctgaaacttggtatgaatattgcaatccgaacatctaacatcaataagaatacaacttgtcgtattagtgacatgaaggattttttaacagtttcagaccatgtggcaaacggtagcttcaaaacactcaaagataatgtgactattgttgataagcctgattattccttatttttacgtaatacagatttgaaaagaaatcttatgggcgataaacgttggattactaaacatagttatgattttttaaagaagtcacatctttatggaggtgaagtaattatctcaaatgtaggtgatgttggaagtgttcaccgagtaccatatcttgatgaacatatggtggctgggaataatgtcattttcattcaatcggctgattcttggattactgattacctatatctgtattttttgtctaacattgggcaacacgccctttccacaatcacgtcgggatctgctcaacaaaagtttaataaaactgattttagggctattgaattaccaattattcctaaaaattttgttaaaaaaaatctcacacccattctcaaaaaaattgattctaacagagttgaagaagattgcttaataacacttcgagatcttctattaccaaggctactttccggtgaaatagatttatctattcttgaggaggtgctaaaaaatgccaaataa

SEQ ID NO: 276 - protein, 300 aa, Lactobacillus coryniformis
LPKFLYYISISDDFRQMAIQSMTGTSGRQRVQSESVINYEFSLPDIEKQTAIVDLLDAIDQKLKINQQINKNLLKLGMNIAIRTSNINKNTTCRISDMKDFLTVSDHVANGSFKTLKDNVTIVDKPDYSLFLRNTDLKRNLMGDKRWITKHSYDFLKKSHLYGGEVIISNVGDVGSVHRVPYLDEHMVAGNNVIFIQSADSWITDYLYLYFLSNIGQHALSTITSGSAQQKFNKTDFRAIELPIIPKNFVKKNLTPILKKIDSNRVEEDCLITLRDLLLPRLLSGEIDLSILEEVLKNAK

SEQ ID NO: 277 - DNA, 1347 bp, Lactobacillus delbrueckii
atggttgaatacacagatgttattaacacagatgtagtatggcttccgcagatcccagcgcattggcaattgcagaaaataggcgccctcttcacagagcgaaagacaaaagtatcggacaaggattatgcgccgttgtcagtaacaaaaaaaggtattcttcctcagcttgagcatgcggcaaaatcaatcgacagcgataaccgcaaattggtgaaagctggagattttgttatcaatagccgttcagatcgaaaaggctcctgcggagtatcgaaattcgatggctcggtttcactcatcaatcttgtgctgacaccacgaagcgggctgaataatgattatgtacattacttgctccgtaattacaaattctcggaagaatactatcggaatggaagaggaattgttgctgatctttggactacacgatacagcgagatgaggaccattctgcttcccgttcctccccgcgcggagcaggatcagattgtgcgcttcctcgactggaaggtatctaaagccaatacgcttattaatattaagaagaaggaaataaagagtgttgagtcactcaagcattctgcggttagcgacgccgtaacgcatggactaactgcggatatacctatgaaatacagcggtgtcaaatggcttggtgatatcccggcacattggactactattaagttacgccagcttttaagttctgtaagcgaaaagaaccatccagagcttccgcttctgtctgtggtcagagagcagggtgtcatcgtacgcgatgtcgatgataaggaagcaaaccacaattatataccagatgatttgagtggctataagatggtcaaaaaaggccaatttgtcatgaataaaatgaaagcatggcaagggtcatatggcatttcagattacacaggcattgtaagccctgcgtattttatctttgatgtggcatttgataaccttgaatacttccactatgccatcaggagcaaagtgtatgtgaatttctttgcacaggcttctgatggtatacgtgtagggcaatgggatctacaaatggacaagatgaaggaaattccatttattgttccgtctgcggatgaacaaattgcaattgttgaacatataaaaaagactcttccgaagtatgacgaagcgattgaaaaaataaaagcagaggtagcggtacttgaagagtacaaagccaagctgatcgctgatattgttaccggcaagattgatgtccgaaatatcactgttcccgagtatgaacacgtagatgacatcgttgacgatgatttggagaataacgaagaaacagagatcgatggagaggaggcttga

SEQ ID NO: 278 - protein, 448 aa, Lactobacillus delbrueckii
MVEYTDVINTDVVWLPQIPAHWQLQKIGALFTERKTKVSDKDYAPLSVTKKGILPQLEHAAKSIDSDNRKLVKAGDFVINSRSDRKGSCGVSKFDGSVSLINLVLTPRSGLNNDYVHYLLRNYKFSEEYYRNGRGIVADLWTTRYSEMRTILLPVPPRAEQDQIVRFLDWKVSKANTLINIKKKEIKSVESLKHSAVSDAVTHGLTADIPMKYSGVKWLGDIPAHWTTIKLRQLLSSVSEKNHPELPLLSVVREQGVIVRDVDDKEANHNYIPDDLSGYKMVKKGQFVMNKMKAWQGSYGISDYTGIVSPAYFIFDVAFDNLEYFHYAIRSKVYVNFFAQASDGIRVGQWDLQMDKMKEIPFIVPSADEQIAIVEHIKKTLPKYDEAIEKIKAEVAVLEEYKAKLIADIVTGKIDVRNITVPEYEHVDDIVDDDLENNEETEIDGEEA

SEQ ID NO: 279 - DNA, 1254 bp, Lactobacillus delbrueckii
atgatacaatcactttacatgaggaaaagaaacgccaacttgagcgctttaatgcagaaaatgttcgctgataagagcgggtatccggctgttcgatttaatggtttttgtgatgagtggaagaagcaaaaattgggagatatagttgagacaattacagattatgttgcggcaggttcttttgccagtctaagggagaacgttatatataggagtaagccttgttatgctcaattaatacgaactgcagatttaaaaagcaactttagcaaaatagctccagtttatgttgataagcaagcctttgattttttatatcgagtaagtctagataaagaatcggtcattcttcctaatattggaaattgtggagaagtttactatgtagatccacatgagcttccctatatgcgaaacgtactgggaccaaatgccatcttaattagaagcagctcattaaataatcattttttgagtatactgtttcaaagtcataattttcaaaagtcattaaagttgattattagccccaatggacaaactaaattcaacaagacagaacttaaacgaattaaaatggttttacccatggatgttaatgaacaaaattccttaagtgcatttttcaaaatgattaatacagcaatatctttacatgaggaaaagaaacaccaacttgagcgcttaaaaagcgctttactgcagaagatgttcgctgacaagagtgggtatccggatattcggtttgaaggatttagtgacgaatgggagcagtgtaagttgggggatgtggcaaagataaattctggaaaggattataaagggctacaaccaggcaaaataccagtttatggcacaggtggttatatgttaagtgtaaatgacaaattatctgatattgatgcaattggtataggccgcaaagggacgattgataagccatattatttaaatgcacctttttggactgttgatacactattttatgtaacacctcgaggtaccgttgatattagttttatgtttcctctattcaaaaatattaattggaaaagatatgacgaatcaaccggggtaccaagcctttcaaaaaataccattaagaagataagagttagctttcctcaaaataatgaacaagttaagattggtgatctctttcaaaagattactcaaatcatcactttacatgatcagaaattaaacttactcaaactcgtgaagcaatctctactacaaaagatgttcatctaa

SEQ ID NO: 280 - protein, 417 aa, Lactobacillus delbrueckii
MIQSLYMRKRNANLSALMQKMFADKSGYPAVRFNGFCDEWKKQKLGDIVETITDYVAAGSFASLRENVIYRSKPCYAQLIRTADLKSNFSKIAPVYVDKQAFDFLYRVSLDKESVILPNIGNCGEVYYVDPHELPYMRNVLGPNAILIRSSSLNNHFLSILFQSHNFQKSLKLIISPNGQTKFNKTELKRIKMVLPMDVNEQNSLSAFFKMINTAISLHEEKKHQLERLKSALLQKMFADKSGYPDIRFEGFSDEWEQCKLGDVAKINSGKDYKGLQPGKIPVYGTGGYMLSVNDKLSDIDAIGIGRKGTIDKPYYLNAPFWTVDTLFYVTPRGTVDISFMFPLFKNINWKRYDESTGVPSLSKNTIKKIRVSFPQNNEQVKIGDLFQKITQIITLHDQKLNLLKLVKQSLLQKMFI

SEQ ID NO: 281 - DNA, 1170 bp, Lactobacillus delbrueckii
ataatgaatgatacacaagctaaatatccgcaattaagatttaaaggtttcgctgatccttgggagcaacgtaagttaggggatgtgtgtgaaccgataacagatagcattgatactcaaaaataccccaacgaagtatttgcagaatatagcatgcctgcattcgatgcatctatgaagccagatattgttttaggttcttcgatgaatagtgttaggaaaataattactagaccatgcttattagtcaacaagctaaacgtgaggaaaaaacggatatggtatgttaaaaaacctaataagaatgcagtctgttcggcagaatttattcctttgtattcagataccgttgatttaactttcttgaatcaagtagccaagagtgaaacttttacaagatatcttgaaaatcactcatctggctcttcaaatagccaaaagcgaattactccacgatcattaatgctttctaagttgcatattccaacaattgaggagcagaagttaattggtaagatctttgaatccctagatcataccatcactttacatgaggaaaagaaacgtcaacttgaatgcttgaaaagcgctttattgcagaagatgttcgctgacaagagtgggtatcctgttgttaggtttgagggatttgataaagcatgggaagagcgtaagttaaaagatgtcgttgaaaagcaaataaaaggtaaggctcaacttgaaaaattagcaccgggagaggttgaatatcttgatacatcaaggttgaatggtggccaagcaatattaactaacggtcttaaagatgtaacgttagatgatattttaattctctgggatggatcaaaagcaggaactgtttatcatggatttgaaggggccttaggctctacactcaaggcttacaggacctctgctaattcaaaatttgtttaccaatatttgaaacgtcaccaagataatatttataacaattatcggacgcctaatataccgcacgtccaaaaagactttctgaatgtatttacgattagcgtaccagtgagtgatgagcaagaaaaaataggttcattctttaaacagctagatgacactatcgcttttcatcaacgtaagttagatttgttgaaagaacagaaaaaaggctttttacaaaagatgttcgtttag

SEQ ID NO: 282 - protein, 389 aa, Lactobacillus delbrueckii
MMNDTQAKYPQLRFKGFADPWEQRKLGDVCEPITDSIDTQKYPNEVFAEYSMPAFDASMKPDIVLGSSMNSVRKIITRPCLLVNKLNVRKKRIWYVKKPNKNAVCSAEFIPLYSDTVDLTFLNQVAKSETFTRYLENHSSGSSNSQKRITPRSLMLSKLHIPTIEEQKLIGKIFESLDHTITLHEEKKRQLECLKSALLQKMFADKSGYPVVRFEGFDKAWEERKLKDVVEKQIKGKAQLEKLAPGEVEYLDTSRLNGGQAILTNGLKDVTLDDILILWDGSKAGTVYHGFEGALGSTLKAYRTSANSKFVYQYLKRHQDNIYNNYRTPNIPHVQKDFLNVFTISVPVSDEQEKIGSFFKQLDDTIAFHQRKLDLLKEQKKGFLQKMFV

SEQ ID NO: 283 - DNA, 1191 bp, Lactobacillus delbrueckii
atgaatgatacacaagctaaatatccgcaattaagatttaaaggtttcgctgatccttgggagcagtgtaagttgggggacgtggcaaaaatcaccatgggtcaatcaccaaattctaaaaattacactgataatccaaaagatcacattctcgttcaaggaaatgcagatatgaaggatggtcaagtacatcctagaatttggactacggaaataacaaaaatcgcagacaaaggtgatttaatcttaagcgttagagcacctgtaggcgatattggaaaaacaagctatgatgtggttatcggtcgtggagtagccgccatcaaaggtaatgaatttatttttcaactgcttaaacgaatgaaaacagtaggttattggactaaatatagtactggttcaacatttgagagcattaattcattagaaataaataatgcggtaataaatctccctaaggagcatgaacaaaataaggttggaaagatactttcctatatggatcatgccatcactttacatgaggaaaagaaacgtcaacttgaatgcttgaaaagcgctttattgcagaagatgttcgctgacaagagtgggtatcctgttgttagatttgaaggatttagtgacgagtgggaagagcgtaagttgggtgatgcggttagtatatcaagtggagtcacgggtgacgcaacacttcaagatggcgaatatagacttacacgcatcgaaagtatttcgcaaggaacgttgaatgttgcgaggttaggattcacaaataaaaaaccagaccagaagtatcttctaaatttgggcgatattctttacagcaatattaactcattgagtcacattggaaaggtggctttggttgatacgacagggatttatcacggaattaatcttttgcgattccaaatgcgcaatgatgttgattcggaatttttatttcagagactaaacacgacgccaatgaaaaattgggcagtttcgcacgcgaatcccgcagtcagccaagcaagcattaatcaaacggaattaagtaaacagccaatttcgttgccaacaataactgaacaacaaaaaataggttcattcttcaaacaactcgacaaaactatcgctcttcatcaacgtaagttagatttgttgaaagaacagaaaaaaggctttttacaaaagatgttcgtttag

SEQ ID NO: 284 - protein, 396 aa, Lactobacillus delbrueckii
MNDTQAKYPQLRFKGFADPWEQCKLGDVAKITMGQSPNSKNYTDNPKDHILVQGNADMKDGQVHPRIWTTEITKIADKGDLILSVRAPVGDIGKTSYDVVIGRGVAAIKGNEFIFQLLKRMKTVGYWTKYSTGSTFESINSLEINNAVINLPKEHEQNKVGKILSYMDHAITLHEEKKRQLECLKSALLQKMFADKSGYPVVRFEGFSDEWEERKLGDAVSISSGVTGDATLQDGEYRLTRIESISQGTLNVARLGFTNKKPDQKYLLNLGDILYSNINSLSHIGKVALVDTTGIYHGINLLRFQMRNDVDSEFLFQRLNTTPMKNWAVSHANPAVSQASINQTELSKQPISLPTITEQQKIGSFFKQLDKTIALHQRKLDLLKEQKKGFLQKMFV

SEQ ID NO: 285 - DNA, 1179 bp, Lactobacillus delbrueckii
atgaatgatacacaagctaaatatccgcaattaagatttaaaggtttcgctgatccttgggagcagtgtaagttaaaaaacaaagcggaaatcgtacgtggagcgagtccaagacctatttctaaccccaaatggttcgatgataattcaaatgttggatggctaagaatatccgatgtcactgaacaaaaaggacgcattcatcacttatcgcaacacatttcaaaagctggtcaatctaaaacgcgtgttatcacagaaccacatttattgttaagtattgctgctactgtgggtagtccagtgatcaattacgttaacacaggagttcacgatggattcttaatatttctcaacccaacatttaataaggaatttatgtttcaatggcttcttatgttcaaaccatattggaacaaatatggtcagccgggaagtcaggttaatttgaactcggatattgtcggaaatcagtctgttgcgtttccaactacgtctgaacaagaaagaattgctaacttcttctctgaattggatactgcaatcactttacatgaggaaaagaaacagcaacttaaatgcttaaaaagcgctttactgcagaaaatgttcgcttataagagcgggtatccagctattcggtttgaaggatttagtgacgaatgggagcagtgtaagttgggggaggtatttaactatgagcaaccaacaaaatatattgtcaaatctacagagtacgatgacaattttaatacccctgttttaacagcaggcaagagtttcttattgggctatacagatgaaattagcgggattaaaaatgctaccgtagaaaatccagttgttatatttgatgattttacaactgactctcattatgtagatttcccttttaaaattaagagctccgcaatgaaattacttagtttgaatgataattctgacaatttctattttatgtttaatacattgaagaatataaaatatgtacctcaaagtcatgaacgtcattggatttctaaattttcatcatttaaaatctataaacctagtcaggaagaacaaaaaaaaataggctcatttttaaaacagctagatgacactatcgctcttcatcaacgtaagttagatttgttgaaagaacagaaaaaaggctttttacaaaagatgtttgtatag

SEQ ID NO: 286 - protein, 392 aa, Lactobacillus delbrueckii
MNDTQAKYPQLRFKGFADPWEQCKLKNKAEIVRGASPRPISNPKWFDDNSNVGWLRISDVTEQKGRIHHLSQHISKAGQSKTRVITEPHLLLSIAATVGSPVINYVNTGVHDGFLIFLNPTFNKEFMFQWLLMFKPYWNKYGQPGSQVNLNSDIVGNQSVAFPTTSEQERIANFFSELDTAITLHEEKKQQLKCLKSALLQKMFAYKSGYPAIRFEGFSDEWEQCKLGEVFNYEQPTKYIVKSTEYDDNFNTPVLTAGKSFLLGYTDEISGIKNATVENPVVIFDDFTTDSHYVDFPFKIKSSAMKLLSLNDNSDNFYFMFNTLKNIKYVPQSHERHWISKFSSFKIYKPSQEEQKKIGSFLKQLDDTIALHQRKLDLLKEQKKGFLQKMFV

SEQ ID NO: 287 - DNA, 1416 bp, Lactobacillus delbrueckii
atgaccccagatcaattaaaagcttccattttgcagtatgccatggaaggaaagttagtctcgcaggacccagatgatgaaccggctagtgagttattgaaaaaaattcagcaagagaagatgaaactggttaaggaaaagaagatcaagaagaccaagccactgccggcaatcagtgaggatgaaattccatttgagattccggatagttgggaatgggtaaggcttgaggaaatagcctatacgattggcaataaaacaaatcagataaaggaaaaagaagttcttccaaaaggtaaattcagggttgtaagtcaatcaaaagaaaaaattattggatattatgacgatgaatcaaaactcttaagagttgatggggactgcatagtttttggagatcacactgctttagtcaagtacattgatttcgattttattattggagccgatggtactaaggtctttaaatgctttaagagaactgatacaaaattcattttttatgtattagagtttgccttgcaaagcattgaaaaaattagtggctattcaagacactataaatatctaaaaaataaatgtctccctcttcctccactagccgagcaaaagcgcattgtagataagctagatagaattatgccgttgattgatgagtatgctaagtcatacacacacctagcagaaattgacagcagtttcaatgatcgcatgaagaaatctattctacagtacgccatggaaggcaagctagtcccgcaggatccaagtgatcagccggcaagcgaactgttagccgaaattcagcaagagaaaactcagctagtcaaggaaaagaagatcaagaagaccaagccgctgccggaaatcagtgaggatgaaattctatatgagattccagaaagttgggtatgggcgagattaagcgatgtaacaaactatattcaaagaggtaagtcgccaaaatattcaaacgatagcgatctatatgtcctatctcaaaagtgcattcagtggtctggaatttcattggagaaagccagatctgtttcatcagagttttgggataagctagaggattatcgttttgttcaatctggagatttattatggaattcaacagggttgggtactgttggtagaataaatatagtggaccaagaagttgctggatatcctgtagattcgcacgttactatagtaagaagttcctctctaatagatagtaggtatttgttaagatacttgatgtctccagttattcagtttaacttaagcgattatttaacgggttcaacaaagcaaaaggaattaggaaaagaaagtattgaaaaaattttagtcccgattcctccactagcagaacaaaagcggattgcagacaaaatagaccaaatttttgatatcttgagttaa

SEQ ID NO: 288 - protein, 471 aa, Lactobacillus delbrueckii
MTPDQLKASILQYAMEGKLVSQDPDDEPASELLKKIQQEKMKLVKEKKIKKTKPLPAISEDEIPFEIPDSWEWVRLEEIAYTIGNKTNQIKEKEVLPKGKFRVVSQSKEKIIGYYDDESKLLRVDGDCIVFGDHTALVKYIDFDFIIGADGTKVFKCFKRTDTKFIFYVLEFALQSIEKISGYSRHYKYLKNKCLPLPPLAEQKRIVDKLDRIMPLIDEYAKSYTHLAEIDSSFNDRMKKSILQYAMEGKLVPQDPSDQPASELLAEIQQEKTQLVKEKKIKKTKPLPEISEDEILYEIPESWVWARLSDVTNYIQRGKSPKYSNDSDLYVLSQKCIQWSGISLEKARSVSSEFWDKLEDYRFVQSGDLLWNSTGLGTVGRINIVDQEVAGYPVDSHVTIVRSSSLIDSRYLLRYLMSPVIQFNLSDYLTGSTKQKELGKESIEKILVPIPPLAEQKRIADKIDQIFDILS

SEQ ID NO: 289 - DNA, 1092 bp, Lactobacillus gasseri
gtgttgattcagaagtttacaactttatttaaagatgtaactaggcagggtactaaaattcctaaagaagaatatttaactcatggaaaaaatataataatagatcaaggacaagatattattgcgggttatacaaattgcgaagatggtatatttaaaaaaattccagctatcgtttttggtgaccatacaaggataattaaatatgttgatactccatttttcttaggagcagatggagtaaaagtgttgaaatgtactgataaaaatgccaattataggtatttatactatgctttaaagaatgcacacattccaaatacaggctataatcgacattttaaatggcttaaagaaataactataaattatccagataaaaatagacaaaacgatattgttaatattcttgataaattagagtacattattaaaatgaaatctcaagaattagataagttcgatgaactaatcaaagcccgatttgtcgagatgtttggagacccgcaagatagtaaatccaagtggaaaaaaagtactattgaaaaatgctgtactctaaaaagtggaaagacattacctcgtaatattgaaaatgaaggcggaaatattccttatgttaaagttaaggatatgaatagtttagaaaatacgacttatataactacttcaactcgatttgtatcagataagacagcaaataaaagtatttttccagttggaacagttatttttccgaagagaggtggagcaattgggacaaataaaaaaagattaacaaaagttccaatttgcgctgatttaaatattatgggagttataccagataatactagaataagctcttattatttatttgaatattttaatatggttgatttaaatactctaaataatggttcgtctgttcctcagattaataacaaagatattaatcccttaaatattaatattccacctctctcactccaaaacgaattcgcaaacttcgtccatcaagtcgacaaatcaaaatttgaaaatatagtatacttgaataaaacgctctcaagcaaaattctcagtcaattaggagatgctatccgtgactaa

SEQ ID NO: 290 - protein, 363 aa, Lactobacillus gasseri
MLIQKFTTLFKDVTRQGTKIPKEEYLTHGKNIIIDQGQDIIAGYTNCEDGIFKKIPAIVFGDHTRIIKYVDTPFFLGADGVKVLKCTDKNANYRYLYYALKNAHIPNTGYNRHFKWLKEITINYPDKNRQNDIVNILDKLEYIIKMKSQELDKFDELIKARFVEMFGDPQDSKSKWKKSTIEKCCTLKSGKTLPRNIENEGGNIPYVKVKDMNSLENTTYITTSTRFVSDKTANKSIFPVGTVIFPKRGGAIGTNKKRLTKVPICADLNIMGVIPDNTRISSYYLFEYFNMVDLNTLNNGSSVPQINNKDINPLNINIPPLSLQNEFANFVHQVDKSKFENIVYLNKTLSSKILSQLGDAIRD

SEQ ID NO: 291 - DNA, 326 bp, Lactobacillus helveticus
gcctttacccccactttcagagcaaagtcgaatcgctgctaaaatagcgcagctattcgctttgcttcgcaaagtcgaaacatctacacaacaatacgcaaaacttcaaactttgctgaagtctaaggtgctggatttggcgatacgtggaaaattggttaagcaagatccaaatgatgagccagcgagtgtgttgcttgagaagattaaggcggagaagcaagagctgatcaaggaaaagaagatcaagaagactaaaccgttgccaccaatcactgatgatgagaagccatttgatattcctgatagttgggaatgggtgagat

SEQ ID NO: 292 - protein, 108 aa, Lactobacillus helveticus
PLPPLSEQSRIAAKIAQLFALLRKVETSTQQYAKLQTLLKSKVLDLAIRGKLVKQDPNDEPASVLLEKIKAEKQELIKEKKIKKTKPLPPITDDEKPFDIPDSWEWVR

SEQ ID NO: 293 - DNA, 257 bp, Lactobacillus helveticus
gtgaagacgaatagtttagattttgatgctcaagctttaagagaaaagatcttggatttagcgatgcgtgggaagttggtaccgcaggatccaaatgatgaaccggctagtgtgcttttggagaagattaaggccgaaaaagctgagctgattaaggaaaagaagattaagaagaccaagccacttcctccgattacagatgatgaaaagccttttgatattcctgatagctgggaatgggttagattaggggatgt

SEQ ID NO: 294 - protein, 86 aa, Lactobacillus helveticus
MKTNSLDFDAQALREKILDLAMRGKLVPQDPNDEPASVLLEKIKAEKAELIKEKKIKKTKPLPPITDDEKPFDIPDSWEWVRLGDV

SEQ ID NO: 295 - DNA, 1452 bp, Lactobacillus helveticus
atgcgtgggaagttggtaccgcaggatccaaatgatgaaccggctagtgtgcttttggagaagattaaggccgaaaaagctgagctgattaaggaaaagaagattaagaagaccaagccacttcctccgattacagatgatgaaaagccttttgatattcctgatagctgggaatgggtcagattaggagatgttggaactattacttctggcggcacacctaaaacctctgaaaaatcatattgggaagaaggaaaaattccttggataactcctgcagtaatgtcagcttctcagaatgatattatttttaataataaagatgttaaatatataaacaatttaggtttagaaaaatcttctgcacatttaattccaaaagattctttagtagtatcaagtcgtgcaccaataggatatgtaaatatagttccttttgaatatactactaatcagggatgcaaatcagtttcattatatgatgatacgaataaacaatttatatattttgcaataaaaaatgcagttccagaaatgaatagacgtgcctccggaacaacttttaaggaaatttctggaaccaaatttggtcaaactatagtgccattacccccactatcagagcaaagtcgaatcgctgctaaaatagcgcagctattcgctttgcttcgcaaagtcgaatcgctgctaaaaatagcgcagctattcgctttgcttcgcaaagtcgaaacatctacacaacaatacgccaaacttcagactttgctgaagtctaaggtgttggatttggcgatgcgaggaaaattggttaagcaagatccaaatgatgagccagcaagtgtgttgcttgagaaaattaaggcggagaagcaagagctgatcaagaaaaaaaagatcaagaagacgaagccgttgccaccaatcacggatgatgaaaagccattcgatattcctgatagttgggaatgggttagattgggggatgtactagatgttagggatggaacacatggcactcctaagtatgtttctgacggtgttccgttagtaaccgctaagaatctgcggaatggtaaaattgatttctctaatataaagtacatatccgaaagtgatgccaagaaaattaatgaaagatcacaagttaatgaaaatgatgtactttttgcaatgataggaacaataggtaatccagtcttagttaatacagatagaattttttctattaaaaatgttgccttattaaaagctaatactttgatcaatatgagatttgtttatatgtatatattaacaatacaagatttattgctaaaaaatgcaagtggtgggaatcaaaaatttctttcgttaagaaaaataaataaactaccgttttcgcttcctccattaccggaacaagtaaagattataaagatggttaatagtttatttgataaggggaagttttaa

SEQ ID NO: 296 - protein, 483 aa, Lactobacillus helveticus
MRGKLVPQDPNDEPASVLLEKIKAEKAELIKEKKIKKTKPLPPITDDEKPFDIPDSWEWVRLGDVGTITSGGTPKTSEKSYWEEGKIPWITPAVMSASQNDIIFNNKDVKYINNLGLEKSSAHLIPKDSLVVSSRAPIGYVNIVPFEYTTNQGCKSVSLYDDTNKQFIYFAIKNAVPEMNRRASGTTFKEISGTKFGQTIVPLPPLSEQSRIAAKIAQLFALLRKVESLLKIAQLFALLRKVETSTQQYAKLQTLLKSKVLDLAMRGKLVKQDPNDEPASVLLEKIKAEKQELIKKKKIKKTKPLPPITDDEKPFDIPDSWEWVRLGDVLDVRDGTHGTPKYVSDGVPLVTAKNLRNGKIDFSNIKYISESDAKKINERSQVNENDVLFAMIGTIGNPVLVNTDRIFSIKNVALLKANTLINMRFVYMYILTIQDLLLKNASGGNQKFLSLRKINKLPFSLPPLPEQVKIIKMVNSLFDKGKF

SEQ ID NO: 297 - DNA, 336 bp, Lactobacillus helveticus
atgcggggaaagttggtaccgcaggatccaaatgatgaaccggctagtgtgcttttggagaagattaaggccgaaaaagctgagctgattaaggaaaagaagattaagaagacgaagccacttcctccgattacagatgatgagaagccttttgatattcctgatagttgggaatgggttagattaggagatgttggaactattacttctggcggcacacctaaaacctctgaaaaatcatattgggaagaaggaaaaattccttggataactcctgcagtaatgtcagcttctcagaatgatattatttttaataatacgcgtggtgctagttaa

SEQ ID NO: 298 - protein, 111 aa, Lactobacillus helveticus
MRGKLVPQDPNDEPASVLLEKIKAEKAELIKEKKIKKTKPLPPITDDEKPFDIPDSWEWVRLGDVGTITSGGTPKTSEKSYWEEGKIPWITPAVMSASQNDIIFNNTRGAS

SEQ ID NO: 299 - DNA, 342 bp, Lactobacillus johnsonii
atgttttttagaacagaaagtggttatgatattctacacaataagaaaaacgaagtaagttatatgcgagtaaaacccagggactttgtaatttatctaagatcatttcaagattgttttgctgcttcagagcttgaaggaataacttccccagcatatactgttattcattttgttgatgataaccaagatttctatttttggaagtatatatttacatccctaaaatttgtaaacagtcttgtaaaagttgcttacgaaattcgcaatgatagaagtatcagttattctgattttaagaatttaaaatggtgcttacctaatagaagagaacaaaagtag

SEQ ID NO: 300 - protein, 113 aa, Lactobacillus johnsonii
MFFRTESGYDILHNKKNEVSYMRVKPRDFVIYLRSFQDCFAASELEGITSPAYTVIHFVDDNQDFYFWKYIFTSLKFVNSLVKVAYEIRNDRSISYSDFKNLKWCLPNRREQK

SEQ ID NO: 301 - DNA, 1941 bp, Lactobacillus kefiranofaciens
atgactcctgaacaattaagagcttctattttgcaatatgcgatggaaggaaaattagttaaacaagatccgaatgatgaacctgcaagtgtgttgcttgaaaagattaagaaagaaaaagagcaactaattaaagatgggaagataaaaaaatctaagccattgccaccaattaccgacgatgaaaagccattcgatattcctgatagttgggaatgggtgagacttaaagaagtaacattgtttggtaattttaaatctgtttccgggagagaaattcctaacggagcttgggtagtagatatgaaagatgttaataagaatggtggcggttttagatctattacaaagaaaactaatagtacagaatataaaagtaataaatatcagttttcaaaaaatagtgttttatatggtaaactacgtccttatttacaaaaagttgaagttgctcagcatgatggatatacaactacagaaatgttgccaattgaagttgttaatgaaaaaaagcttaatccgttatatttgcgttatgttttactatctccatattttgtagataatataaatgcttcggtatatggtgtaaaaatgccaagagttggtactaattttttagcatgtatgatattaccattaccttctttaaatgaacagaaacgtatagttactaaaataaaaaagtttatgcctctaattgctcaatacgctgaaacatataatcgtcttcaaaagattgatagtgaattcaaaggtaagttgaagcaatctatacttcagtgtgcgatgcgtgggaaattggttaagcaagatccaaatgatgagccagccagtgtgttgcttgagaaagataatttaaagaatagcgatgaaaaaccacatgatattccagcgtcatggaaatggattatattaggctcaggtgtaaatttttataatggaagagcatataaaaagaatgaattattgaatgatgataaatttacaccagttctaagggtaggtaatctttttactaattcttcttggtattattcagatcttaagttagatccaaataaatatattgataatggtgatttaatttatgcatggtctgcttcctttggccctaaaatttggaatggtggtcgtgtaatttttcattatcacatttggaaattaaagtatgataatactgctattgataaaaacttcttatactattttttattagataaacgtaatgtggttggtgaaactgacttgcatggttccacaatgaagcatattactaaaacaaatatggaacatttaccattccctttgccacctctttcagagcaaagtcgaaacgctgctaaaatagcgcagctattcgctttgcttcgcaaagtcgaaacatctacacaacaatacgcgaaacttcagactttgctgaagtccaaggtgctggatttggctatgcgagggaaattggttaagcaagatccaaatgatgagccagcgagtgtgttgcttgagaagattaaggcggagaagcaagagctgatcaaggaaaagaagatcaagaagacgaagccacttcctccgattacagatgatgagaagccttttgatattcctgatagttgggaatgggttagatgtaaggctgttaccacaatgggaaattttaaaacagttaatccttctgatgttcagatcggtgaaaatttaattgaattagcagatattgaagctaatagtggtcatttaataaaagaagaaattgtgactagtacagttggtagtaataaatatgtctatacagaaggcgatgtattatttgcaaaattaagaccatatttaagaaaagtcttaattgcgccaaatgatggtgtttgcactactgaattgttacctataaagggaatcaatactaataataatttttttgtattatgttttcttatctga

SEQ ID NO: 302 - protein, 646 aa, Lactobacillus kefiranofaciens
MTPEQLRASILQYAMEGKLVKQDPNDEPASVLLEKIKKEKEQLIKDGKIKKSKPLPPITDDEKPFDIPDSWEWVRLKEVTLFGNFKSVSGREIPNGAWVVDMKDVNKNGGGFRSITKKTNSTEYKSNKYQFSKNSVLYGKLRPYLQKVEVAQHDGYTTTEMLPIEVVNEKKLNPLYLRYVLLSPYFVDNINASVYGVKMPRVGTNFLACMILPLPSLNEQKRIVTKIKKFMPLIAQYAETYNRLQKIDSEFKGKLKQSILQCAMRGKLVKQDPNDEPASVLLEKDNLKNSDEKPHDIPASWKWIILGSGVNFYNGRAYKKNELLNDDKFTPVLRVGNLFTNSSWYYSDLKLDPNKYIDNGDLIYAWSASFGPKIWNGGRVIFHYHIWKLKYDNTAIDKNFLYYFLLDKRNVVGETDLHGSTMKHITKTNMEHLPFPLPPLSEQSRNAAKIAQLFALLRKVETSTQQYAKLQTLLKSKVLDLAMRGKLVKQDPNDEPASVLLEKIKAEKQELIKEKKIKKTKPLPPITDDEKPFDIPDSWEWVRCKAVTTMGNFKTVNPSDVQIGENLIELADIEANSGHLIKEEIVTSTVGSNKYVYTEGDVLFAKLRPYLRKVLIAPNDGVCTTELLPIKGINTNNNFFVLCFLI

SEQ ID NO: 303 - DNA, 1236 bp, Lactobacillus paracasei
atgaatgcagaacaacatgtgcctccgtttaggtttaaaggtttttctgatttttgggaacagcgtaagctatcagaccttgctatgttcaaccctaggttggagctgcctgattcattccaatacgttgatcttgaatctgtaagtggaacggaattgattaaccatcgaactgaaaccaagtcatctgctccatctagggcgcaaaggctggcaaaaaaaggcgatatcttctatcaaacagttcgtccatatcagaagaataactatctctatgagaaatcggatgatgattatgtattctcaaccgggtatgcgcagcttcggccttatgaggatggatattttctctttagtcgactgcaagaaaacggctttgtctccacagtgttggaccatagtacgggtaccagctatccagctataaactccaatgacctcgcaaagctagagatcatggttcctcttaatctgaacgaacagcaagcaattggaaaactatttcgccacattgacaacgctatcgctcttcatcagcataagctagctaagcttaaagaacttaaaaagggctatttgcagaaattattccctcaaaatggtgagacggtgcctgagtttagatttaagggatattctgacgcttgggaaaagcgtaagtttgttcagatgctaaataattcagatggtttaagaagagggccatttgggagtgctttaaaaaaagctttttttgttaaagaaagttcttttgttgtctatgagcagcaaaacgcaatttacgatcggtttaatacaagatatcgaatttcagagaagaagtttgcagaacttcataattttgaggtgcttcccggagattttttattaagtggagctggaacgattggaagaattgcaagagttccgaaggggattgaacaaggagtttttaatcaggcattaatccgactcaggattaatgaaagtatgacggattccgagttttttttacaattcattcgatcagacttcatgcaaaaaaatctaacagaaactaatcctggttctgcgattcaaaatttagttcctatgtcagaattaaaaaattggacagttagaacacctgtagttaatgaacaacggaaaattggttctcttctcaaaaaaattgacagccttatcgctgcaactcagtgtaagttagatttgttgaagaaactcaaaaagggctatttgcaaaagatgttttgctga

SEQ ID NO: 304 - protein, 411 aa, Lactobacillus paracasei
MNAEQHVPPFRFKGFSDFWEQRKLSDLAMFNPRLELPDSFQYVDLESVSGTELINHRTETKSSAPSRAQRLAKKGDIFYQTVRPYQKNNYLYEKSDDDYVFSTGYAQLRPYEDGYFLFSRLQENGFVSTVLDHSTGTSYPAINSNDLAKLEIMVPLNLNEQQAIGKLFRHIDNAIALHQHKLAKLKELKKGYLQKLFPQNGETVPEFRFKGYSDAWEKRKFVQMLNNSDGLRRGPFGSALKKAFFVKESSFVVYEQQNAIYDRFNTRYRISEKKFAELHNFEVLPGDFLLSGAGTIGRIARVPKGIEQGVFNQALIRLRINESMTDSEFFLQFIRSDFMQKNLTETNPGSAIQNLVPMSELKNWTVRTPVVNEQRKIGSLLKKIDSLIAATQCKLDLLKKLKKGYLQKMFC

SEQ ID NO: 305 - DNA, 729 bp, Lactobacillus pentosus
cacctcgacaccctcatcgcagtcaaccagcgtaagttagctaagcttaaggcacttaaacagggctatttgcaaaaattgttccccaaaaatgggagcaagttcccagaattaagatttttagggtttgctgacgcttgggaacagcgtaagttcttcgacaacattagacgtacagtagattttcgtggacgtactcccaaaaaactggatatggattggagcgagtctggatatcttgccctttcagctcttaatgtaaaaaatggttatattgatccatctgctgatgcacattatggaaatcaaaaactatatgataagtggatgactggaaaagaactttataagggccaagtattatttaccacagagccaccaatgggaaatgtggcacaaataccggacaacaacaaatatattctcagtcaacgaacaatcgcttttgatgttgcttcagataaaatcacaaatgatttcttggctgtcttgttacgttcgccgaaatcatttaatgaattatcatccttatcaagcggcggtactgcgaaaggtgttagtcaaagatctttatcacagttcaaagtaacactacctaaaagtttacaagaacaaaagaaaattggcatttttttcaaacaactcgacaagactatcgctctttatcagcgtaaacttgaaaaactccaggaactcaaaaaaggatatctacaaaagatgttttgctga

SEQ ID NO: 306 - protein, 242 aa, Lactobacillus pentosus
HLDTLIAVNQRKLAKLKALKQGYLQKLFPKNGSKFPELRFLGFADAWEQRKFFDNIRRTVDFRGRTPKKLDMDWSESGYLALSALNVKNGYIDPSADAHYGNQKLYDKWMTGKELYKGQVLFTTEPPMGNVAQIPDNNKYILSQRTIAFDVASDKITNDFLAVLLRSPKSFNELSSLSSGGTAKGVSQRSLSQFKVTLPKSLQEQKKIGIFFKQLDKTIALYQRKLEKLQELKKGYLQKMFC

SEQ ID NO: 307 - DNA, 1143 bp, Lactobacillus plantarum
atgaaaaacgaaaatttagtgccaaaagtgcggtttaaggggtttagtgacccttgggagcagcgtaagcttggagaacttggcaaaattcaaggcggtggaactccagattcaggtatagcagaatattgggatggaaatgttaactggtttacaccgaccgaggtttcaaataatggctatttagaaagtagtaataggaaaataaccagtttaggattgaaaaagagttcagcccgtttaatgccagcttctactgtacttattacatctcgtgcgggtgtcggtagaatgggaatacttaaatatcctgcatctacaaatcaaggcttccagtcattaattcttaattctgcaactgatgaatattttatttactcgatgcagccaataataagcaaactggcaaatagactagcgtctggatcaactttcactgaaatatccggtaaacaaatggaaaaaatcgaaattatgattccaactactggagaacaaaatcgaatcagtagtctaatgaagtgcattaataaccttatcgctgccaatgaggataaactagaacagttaaaaactctcaaaaagttgatgatgcaaaagattttttctcaggaatggcgcttcaagggattcactgacccatgggagcagcgtaagcttggagatatatcaaaaataactgctggcggagatattgataaggataagctcagtactcgcggaaggtatccagtaattgcaaatgcgttaactaataatggagtagtcggctactatgattcatataaggtaaagggaccggctgtcacggttacagggcgtggagacgtgggacatgccaaaacaagaattgaaagttttactcctatagtaagacttttagtggtaagtgcacctaattttgacattaattttttggagaatgcaattaataatatcagaatttttaacgaatcgacaggagtccctcagcttaccgcacctcaacttggttcctatgaattcgaatatccctgttctagtgaacaagtttgtataggcaatgtactgcataagattgataaccttatcgctgccaatgaagataaactaaaccaacttaaagagttgaagaaatatttaatgcaaaatatgtttgtttaa

SEQ ID NO: 308 - protein, 380 aa, Lactobacillus plantarum
MKNENLVPKVRFKGFSDPWEQRKLGELGKIQGGGTPDSGIAEYWDGNVNWFTPTEVSNNGYLESSNRKITSLGLKKSSARLMPASTVLITSRAGVGRMGILKYPASTNQGFQSLILNSATDEYFIYSMQPIISKLANRLASGSTFTEISGKQMEKIEIMIPTTGEQNRISSLMKCINNLIAANEDKLEQLKTLKKLMMQKIFSQEWRFKGFTDPWEQRKLGDISKITAGGDIDKDKLSTRGRYPVIANALTNNGVVGYYDSYKVKGPAVTVTGRGDVGHAKTRIESFTPIVRLLVVSAPNFDINFLENAINNIRIFNESTGVPQLTAPQLGSYEFEYPCSSEQVCIGNVLHKIDNLIAANEDKLNQLKELKKYLMQNMFV

SEQ ID NO: 309 - DNA, 387 bp, Lactobacillus plantarum
ttgaaattaggtgatattgtctttacgcgaactggagcaagtacgggaaagacttttatctacagaactgcagacagtattgtttattacgccggttttttaataaaaatgtctgttagagaagacatagattcagaatttgtttttcaaaatactttaacaacatcttttaatagatttgtaaaagtgatgtcgcaacgatctggccaacctggaatcaactcaaaagaatatgcccgctttaagttatatattcctaaactaaaagaacaggtattagtgggtaacatgctattattgattgataaccttatcgctgccaatgagtataatctgaaaaacgccctcaacattcgaggacgttttaatctgcacttattaatgtaa

SEQ ID NO: 310 - protein, 128 aa, Lactobacillus plantarum
MKLGDIVFTRTGASTGKTFIYRTADSIVYYAGFLIKMSVREDIDSEFVFQNTLTTSFNRFVKVMSQRSGQPGINSKEYARFKLYIPKLKEQVLVGNMLLLIDNLIAANEYNLKNALNIRGRFNLHLLM

SEQ ID NO: 311 - DNA, 492 bp, Lactobacillus plantarum
ctgaaaaacatttcattggaaattggtactggtaagagcagattcattaaattcaataaatctgaaaaatatatgtataaaatattgggctctacatcaattattgggtacactaaccattttgattatgagggagattttatattaactgctcgtgtaggagctaacgctggaactatctatcgagaatcaggaaaagtaaagattagtgataatacagtttttataaaagcgagtcaaatcaactttttatattatgttttaacaaattataatttgaaaagactatctttcggaactggtcagccacttataaaatcatctgaattaaataaattaaaattggaagtaccgacgaatgaacttgagcagcaagaattaggggtaatatttttcacaatagatacccttatcgctgccaatgagcaagtcccaaaattagtcattaaaatagtaaataattctctagctaattcatcgttttccaactaa

SEQ ID NO: 312 - protein, 163 aa, Lactobacillus plantarum
MKNISLEIGTGKSRFIKFNKSEKYMYKILGSTSIIGYTNHFDYEGDFILTARVGANAGTIYRESGKVKISDNTVFIKASQINFLYYVLTNYNLKRLSFGTGQPLIKSSELNKLKLEVPTNELEQQELGVIFFTIDTLIAANEQVPKLVIKIVNNSLANSSFSN

SEQ ID NO: 313 - DNA, 1113 bp, Lactobacillus reuteri
atgaaatataggttaggcaatatttgtaagattggtgatggattacatggtacgccaaactattgtaaaaataatgaattctattttataaatggcaataacttaaaaggtgaacttattgatttaagtaacgcaaggtctgtttcaaaagctgaatacctaaaatacaatcctaatttaatacctcaaaagacagtattactttccataaatggtactttgggaaatacagcaatatataatggtgaatctataattttaagtaaaagcgttgctttttttgaatgttcgaccgatattataactcctgaatatttaaaattatattttgagtcttgcaatttccaaaacatcttaaataatatggctacaggaactacaataaaaaatgtaggattgaaatcgttaagatctttaatgattgatttaccatctataaatattcaaagagagattgttaatataattaagccctttgagaataaattatatttgaataatcagataaatgataatttaatgaagttaaataccttattatttcagcaattatctgttgacagtgactataccttgtcgaattttactgattgtcagaatggtttcgcctttaagagttcagagtatataacaaataatgaactattaatattgagaaccttaaatatgaccagtgatcatttgttttctaaaaatggagtgaaatatatttccaaagtttataaggaaaaatatcaaaaatttgaattcaagaaatttgatacgacattagtaatggttggcgcttcaattgggaaaatggctttaataacaacaaatgttatcccttctcttcaaaatcaaaatatgtggagatttagatctaaatcaaaaatgccaggtctccttatatacgatatggttcagtatgttaatgatcgtgtaagaagctcagccactggaagtgcaagaagcttttacaggaaaaaaatgtttttaaattcaaaagtaccagttataagtgaaaaatattatgacattttcttagcaatccaagagaagataaataatattgctaacgagaatgaaacgttgtcgaatctaaagaatgttttgttatcgaaatacttttaa

SEQ ID NO: 314 - protein, 370 aa, Lactobacillus reuteri
MKYRLGNICKIGDGLHGTPNYCKNNEFYFINGNNLKGELIDLSNARSVSKAEYLKYNPNLIPQKTVLLSINGTLGNTAIYNGESIILSKSVAFFECSTDIITPEYLKLYFESCNFQNILNNMATGTTIKNVGLKSLRSLMIDLPSINIQREIVNIIKPFENKLYLNNQINDNLMKLNTLLFQQLSVDSDYTLSNFTDCQNGFAFKSSEYITNNELLILRTLNMTSDHLFSKNGVKYISKVYKEKYQKFEFKKFDTTLVMVGASIGKMALITTNVIPSLQNQNMWRFRSKSKMPGLLIYDMVQYVNDRVRSSATGSARSFYRKKMFLNSKVPVISEKYYDIFLAIQEKINNIANENETLSNLKNVLLSKYF

SEQ ID NO: 315 - DNA, 1143 bp, Lactobacillus rhamnosus
atgagtaaggataccagaaacgttcccgcattaaggtttaaggggttttcggacgcttgggaaaagcgatgtttgaaagaaatattatcagtaaactcaggacgagattataagcatcttttgccgggaaaagttcctgtttatggtacgggtggttatatgctgagtgtcaatgaggcactttctcactcagatgctattggaattgggagaaaaggaacaattgatagaccttttttcttaaaggcccctttttggacagtagataccctcttttttttaacagtgaagaaagagatggtgctctcgtttgtctttccacttcttcagacgattcggtggaagcaactggatgagtcaacaggagttccaagcttatcaaaaaagaccatcgaatcgataatggtacatgtgccacaaaaagaagagcaacagatcataggcaacacatttatcttaatagacaaccttatcgctgcaactcaagataaacttgaaaaattaagcgtacttcaacgaggctttctacagcatttttttgctcaaacttggagattttctggatactcgcatgcatgggagaattatagactgggtgatgtatccacacgtgttcgtggaaatgacggtagaatgaatctgcctatattgacgatttctgcggggaaaggatggctaactcaagaacagcgattctctcaaaatattgcaggaaatgagctaaaaaaatatacgctgctgtctaaaggagaactgtcgtacaatcatggcaattcaaagcttgccgaatatggagctgtcttcgtgttaaaacaatttaaagaagctctcgtgccacgtgtctaccatagctttaatatttcagggaaagcggatcctgattttattgaatacttatttgaatccggagtgccaaaccacgaactaagaaaattaatttcttctggagcaagaatggacggccttttaaatattaattacgactcttttatgaatatatcagtacgtttaccgtcaattgaagaacaaaataaaatagcgcgagttcttgaaaaattgaagaaacttactgatgagactaggttgagactttttaatttgcaacaggcaaagaaatccttgttaaggatgctctttccgtag

SEQ ID NO: 316 - protein, 380 aa, Lactobacillus rhamnosus
MSKDTRNVPALRFKGFSDAWEKRCLKEILSVNSGRDYKHLLPGKVPVYGTGGYMLSVNEALSHSDAIGIGRKGTIDRPFFLKAPFWTVDTLFFLTVKKEMVLSFVFPLLQTIRWKQLDESTGVPSLSKKTIESIMVHVPQKEEQQIIGNTFILIDNLIAATQDKLEKLSVLQRGFLQHFFAQTWRFSGYSHAWENYRLGDVSTRVRGNDGRMNLPILTISAGKGWLTQEQRFSQNIAGNELKKYTLLSKGELSYNHGNSKLAEYGAVFVLKQFKEALVPRVYHSFNISGKADPDFIEYLFESGVPNHELRKLISSGARMDGLLNINYDSFMNISVRLPSIEEQNKIARVLEKLKKLTDETRLRLFNLQQAKKSLLRMLFP

SEQ ID NO: 317 - DNA, 1182 bp, Lactobacillus rhamnosus
gtgactacaaataaacaaatggtaccggagcttcgcttcaaggggttcactgacgcttgggaacagcgtaaggtttcagaactagcagaccgctatgataatcatcgagttccaattacagcatccgaacgtgtagcagggagaacaccttattacggtgcaaatggtattcaggatcatgttgaaggttttactcatgatggtgaatttattttggttgcagaagacggtgcgaatgatttgcaaaactaccctgttcaatatgttgatggtaaggtttgggtcaacaatcatgcccacgttcttcaagctaaagaagaaacagcggacaacaaatttttgatgaacgctttgaaacataccaacatagaaccctatttagttggcggtggacgtgctaaattaaatgccgatgtcatgatgaagattgattttaaagttccgacattacctgaacaaattcaaattggtaagtttttcgataatctcgaccatctcatcacccttcatcagcgtaaactggagctgctcaagagacttaaacagggttacttgcagaagttgtttcctcaaaatggagaaaatgtacccgagttgcgatttaaagggtattctgacgcttgggaaaagcgtaagttgggagagatttctgatattagaggcggtggcacccctagcacctcaaagccagaatattgggacggagaaattgactggtatgctcctgcagaaataggtacacagagatatgtttctggaagcagacggcaaatcacaaatcttgggcttaataaaagttcggcaaccatgctgcctgcaaataaaacaattttgtttactagcagagccggtattggcaatgcagcaattctcacaaagtccggggcaactaatcagggatttcaatcgatagttgtagaaccagcaactgatgtttatttcttatatagtgaaattcctgaaataaaacgcaaagcaattagattagctgctggctccacttttctagaaatatctgggaagtcgctaagcaagattcaaatctggctgccaagtttcaaagagcaatccagaattggacatttatttttgcagatagataaccttatcgctgcaactcaacacaaggaaaacttacttaaaaaaatcaaacaggcctgcttgcaaaacatgttttgctag

SEQ ID NO: 318 - protein, 393 aa, Lactobacillus rhamnosus
MTTNKQMVPELRFKGFTDAWEQRKVSELADRYDNHRVPITASERVAGRTPYYGANGIQDHVEGFTHDGEFILVAEDGANDLQNYPVQYVDGKVWVNNHAHVLQAKEETADNKFLMNALKHTNIEPYLVGGGRAKLNADVMMKIDFKVPTLPEQIQIGKFFDNLDHLITLHQRKLELLKRLKQGYLQKLFPQNGENVPELRFKGYSDAWEKRKLGEISDIRGGGTPSTSKPEYWDGEIDWYAPAEIGTQRYVSGSRRQITNLGLNKSSATMLPANKTILFTSRAGIGNAAILTKSGATNQGFQSIVVEPATDVYFLYSEIPEIKRKAIRLAAGSTFLEISGKSLSKIQIWLPSFKEQSRIGHLFLQIDNLIAATQHKENLLKKIKQACLQNMFC

SEQ ID NO: 319 - DNA, 1176 bp, Lactobacillus rhamnosus
atgacccctattttttatccgataaacgcttgggaaaagcgtaagtttggagatttatacagtaaaacttctgaaaagaatgatggcagttttggaccggacaagatcatttcagttgcaacaatgtcttggaagacaaatgtgcgtatatctagtgaagactatctggccacatataatgttctaagaaagggagatattgcctttgaagggaacaaaagtaagaaattttcatttggtcgatttgtggagaatgatataggagacggcattgtctcccacgtttttgtcgtttttcgccccaaagtgtccccgataatctcttactggaagtacttcattcacaacgagtttgttatgaggaatattctgcgaaaatcaacgattaaggctacgatgatgactaacttgagttctcatgactttcttcgacaaacactctgtaccccgagtttcaaagaacaagaaaacattgggaactttcttgaaagactagacagccttatcgctgcaactcaagataagcttgaaaaattaagcatacttcaacgaggctttctacaacatttttttgctcaaacttggagattttctggatactcgcatgtatgggagaatcatagactgggtgatgtagccacacgtgttcgtggaaatgacggtagaatgaatctgcctatattgacgatttctgcgggtaaaggatggctaactcaagaacagcgattctctcaaaatattgcaggaaatgagctaaaaaaatatacgctgctgtctaaaggagaattgtcgtacaatcacggcaattcaaagcttgccgaatatggagctgtctttgtgttaaaacaatttaaagaagctctcgtcccacgtgtctaccatagctttaatgtttcagggaaagcggatcctgattttattgaatacttatttgaatccggagtgccaaaccacgaactaagaaaattaatttcttctggagcaagaatggacggccttttaaatattaattacgactcttttatgaatatatcagtacttttaccgtcaattgaagaacaaaataaaatcgcgcgagttcttgaaaaattgaagaaacttactgatgagactaggttgagactttttaatttgcaacaggcaaagaaatccttgttaaggatgctctttccatag

SEQ ID NO: 320 - protein, 391 aa, Lactobacillus rhamnosus
MTPIFYPINAWEKRKFGDLYSKTSEKNDGSFGPDKIISVATMSWKTNVRISSEDYLATYNVLRKGDIAFEGNKSKKFSFGRFVENDIGDGIVSHVFVVFRPKVSPIISYWKYFIHNEFVMRNILRKSTIKATMMTNLSSHDFLRQTLCTPSFKEQENIGNFLERLDSLIAATQDKLEKLSILQRGFLQHFFAQTWRFSGYSHVWENHRLGDVATRVRGNDGRMNLPILTISAGKGWLTQEQRFSQNIAGNELKKYTLLSKGELSYNHGNSKLAEYGAVFVLKQFKEALVPRVYHSFNVSGKADPDFIEYLFESGVPNHELRKLISSGARMDGLLNINYDSFMNISVLLPSIEEQNKIARVLEKLKKLTDETRLRLFNLQQAKKSLLRMLFP

SEQ ID NO: 321 - DNA, 1209 bp, Lactobacillus rhamnosus
atgagtaagggtaccagaaacgttcctgcattaaggtttaaggggttttcggacgcttgggaaaagcgtaagtttggagaactctacaaaccgaataaagagagaaatgagagcgcagaattttcaagtgaaaatacattgtcgatcgcaacaatgacagttaatagaaagggtaatggtgccgccaaaacgtcgcttttaaaatataaggttattcgtataggcgacatagcatttgaaggccacacgagtaaaaagtttgcctttggtcgtttcgttcttaacgatgtggcagacgggattatgtcgcctcgttttacctgcttaagaccaattcatcgacaaattatccaattttggaaacagtatattcattatgaaccaattttgcggcctattctaattcgttctacaaagttaggaacaatgatgaatgaactggttgtcccagacttactaaaacaaaatattcgtgttccgagtatcaacgaacagaaacttattggtaagagtctttctagagttgatgaccttatcgctgcaactcaaggtaaacttgataaccttgagaagatcaaaagggcgctattaaagcatctctttgaccaatcaatgaggttcagaggttactctgacccgtgggaaaagcgtaagttgattgatcaattgtccttgctaaaagatggaactcatggcacacataaagacggtaactttgcgtttctattaagtgcgaaaaacgtaattcaggattctatagttttcgatgattctgacagaaagatttctgaagatgattttaatgatatttatgccaattatcatataaagaaaaatgatgttcttcttacaattgtcgggacaataggcagagtcgcgcttttcccgaggctgactgttccggtggctttccagcgcagtgtggctattttgcgaacaaagccgacactttttccatactttcttgctttggagttacaaacgccaacaattcaatctaaaatcaaggccagagctaatatgtcagcgcaagcaggaatatacttgggtgatttaaagaaagttgttatatctattccaaaatcagaagaacaaattgaaatagccatgtccttaaaccgattaacaaaccttatcgctgcaactcaatccaaactttcaagcctcgaaacattaaaaaaagccctattacaaggacttttcatttga

SEQ ID NO: 322 - protein, 402 aa, Lactobacillus rhamnosus
MSKGTRNVPALRFKGFSDAWEKRKFGELYKPNKERNESAEFSSENTLSIATMTVNRKGNGAAKTSLLKYKVIRIGDIAFEGHTSKKFAFGRFVLNDVADGIMSPRFTCLRPIHRQIIQFWKQYIHYEPILRPILIRSTKLGTMMNELVVPDLLKQNIRVPSINEQKLIGKSLSRVDDLIAATQGKLDNLEKIKRALLKHLFDQSMRFRGYSDPWEKRKLIDQLSLLKDGTHGTHKDGNFAFLLSAKNVIQDSIVFDDSDRKISEDDFNDIYANYHIKKNDVLLTIVGTIGRVALFPRLTVPVAFQRSVAILRTKPTLFPYFLALELQTPTIQSKIKARANMSAQAGIYLGDLKKVVISIPKSEEQIEIAMSLNRLTNLIAATQSKLSSLETLKKALLQGLFI

SEQ ID NO: 323 - DNA, 600 bp, Lactobacillus rhamnosus
atgaccagtcaaaaccggaggcccacaatgaaggataaccaaactaaatatccgcaattaagatttaaaggtttcactgatccttgggaagatcgtaagttatcagacattgccgatagatttgataacttacgtgtacctataacagcatccgatcgaaaacctggagataccccatattacggagctaatggtattcaagattatgttgaaggatttacgcataatggtgaattcattttagtagcagaagatggagcaaatgatctaaaaaattatcccatacaatacgttaatggcaaggcttgggttaataatcatgcacatgttcttcagggtaaaaagacaattacagataataagttcttgatgaatgctattaagaatttcaacatagagccattcttagttggtggtggacgtgcaaaacttaatgcagatgtcatgatgaaattaaatattctgttaccaacttttgtcgaacaagaaaaaatcggttcattatttagtcttttagataagactatcgctcttcatcagcgtaagcttgaaaaactccaagaacttaaaaaagggtatctacaaaagatgttttgctga

SEQ ID NO: 324 - protein, 199 aa, Lactobacillus rhamnosus
MTSQNRRPTMKDNQTKYPQLRFKGFTDPWEDRKLSDIADRFDNLRVPITASDRKPGDTPYYGANGIQDYVEGFTHNGEFILVAEDGANDLKNYPIQYVNGKAWVNNHAHVLQGKKTITDNKFLMNAIKNFNIEPFLVGGGRAKLNADVMMKLNILLPTFVEQEKIGSLFSLLDKTIALHQRKLEKLQELKKGYLQKMFC

SEQ ID NO: 325 - DNA, 1182 bp, Lactobacillus rhamnosus; identical to SEQ ID NO: 317

SEQ ID NO: 326 - protein, 393 aa, Lactobacillus rhamnosus; identical to SEQ ID NO: 318

SEQ ID NO: 327 - DNA, 852 bp, Lactobacillus salivarius
atggataataagaaaaatggtatacctaagttaagattcccaggatttactggagcttgggaacagcgaaagttgggggaagtggctgatgttagagatggcactcatgactcgccaaaatatattaatgagggttatccgttattgacatctaagaatgtaggtaatggatacataaactatgacgatgttaaatatgtatcagaaaaagactacgttcaaataaacaaacgatcaaaagttgatgttaatgatattcttatgggaatgattggaattattggaaatcttgctttaattcgtgaagaaccggattttgccattaaaaatgttgccctaataaaacatacctctaattttgactatcaatttttatttcaagaattacagacaaattctatttcaaaagaattactaagtggaatggatggaggaacacaaaaatttatttcattgaaaaaaataagaaatttaagtgttatgtttccatcaaaaaatgagcaaaaccaaattggcttatctttagcacgctttgacgaccttatcgcccttcatcagcgtaagcttgagcatttgcaagagcagaaaaaaggtctacttcaaaaaatgtttcctaaaaatggggaagttgttccagaagtgagattcccaggatttactgacgcttgggaacagcgaaagttgggggaagtggctgatgttagagatggcactcatgactcgccaaaatatattaatgagggttatccgttattgacatctaagaatgtaggtaatggaaacataaactatgacgatgttaaatattgtatcagaaaagactacgttcaaataaacaacgatcaaaggtga

SEQ ID NO: 328 - protein, 283 aa, Lactobacillus salivarius
MDNKKNGIPKLRFPGFTGAWEQRKLGEVADVRDGTHDSPKYINEGYPLLTSKNVGNGYINYDDVKYVSEKDYVQINKRSKVDVNDILMGMIGIIGNLALIREEPDFAIKNVALIKHTSNFDYQFLFQELQTNSISKELLSGMDGGTQKFISLKKIRNLSVMFPSKNEQNQIGLSLARFDDLIALHQRKLEHLQEQKKGLLQKMFPKNGEVVPEVRFPGFTDAWEQRKLGEVADVRDGTHDSPKYINEGYPLLTSKNVGNGNINYDDVKYCIRKDYVQINNDQR

SEQ ID NO: 329 - DNA, 558 bp, Lactobacillus salivarius
atgaaattgaacaaattggtaaaaattgaaagtggaattaattcagttcgcgtaaaggatcaaaattatacgctatataccatagaagatgtcaattatgacttaggtcatggtgaggattatcaacacgataaggctagtggcaaaagtattacagcaaagggagatgttgtgattaatactgtaagtaatttggcaagtgttgttcattctagaaatgctggtaagatgcttaatcaaatttttcttcgtttaaatatccttgatgagaatacactagacccttggtatttatgctatttattaaataagtccgaatacattagataccaggaagctgctattatggatggatctgttattagaaagctaactaaagctaatcttgaagatttagagattaatctgccgggaatagctgaccaaaagaagatgggggaagcttacaaagagattatgaaaaagtatacattagctatggagaaagcggagttagaaagagagctgtacttacaaatgttaggggaaaaagatttaaacaacagagaggtggtttaa

SEQ ID NO: 330 - protein, 185 aa, Lactobacillus salivarius
MKLNKLVKIESGINSVRVKDQNYTLYTIEDVNYDLGHGEDYQHDKASGKSITAKGDVVINTVSNLASVVHSRNAGKMLNQIFLRLNILDENTLDPWYLCYLLNKSEYIRYQEAAIMDGSVIRKLTKANLEDLEINLPGIADQKKMGEAYKEIMKKYTLAMEKAELERELYLQMLGEKDLNNREVV

SEQ ID NO: 331 - DNA, 1290 bp, Lactobacillus salivarius
atggtgaagatgaaagatagtgggattgaatggattggtgaaatcccagaaacttgggagaaagtaaaattcaatgctatttatagtaataggaatactaaagttagtgatcgagaatacgctccattatctgttactaaaaagggaatcgttcctcaactagcaactgcagccaaaactaatgataatgataatcgtaaactcgtaaaatcaggtgattttgtcattaatagtcgctcagatagacgtggttcatgtggaatttcttcattagatggttctgtttcgttaattaatacagttttagaacctaaaaatagtcagatggagcccttatattttgattttttgtttcataccattcaatttgcagatgagttctacaaatggggacatggaatagtagatgatttatggacaactaactggaatgacatgaagaatataactttaattcttccgacaagatttgaacaacaattaattgctgatttcctcgaccataaaacagctgagattgatggcttgattgacaaaattaataccgaaattgatactcttaagcaatatcaaagtagcgtaattactcaagcggtgactaaaggtctggatcctaatgtgcctatgaaggatagcggaattgaatggattggtgagataccagaagcgtggagaacaatcgctataaaatatacatcatggcttaagggaagaataggttggcaaggccttactagcgatgaatatataaatgatggaccttatcttataacaggaactgactttaaaaatgggatgattaattgggagtcatgtgttcacatatctgaagaaagatttgaacaggatgcagatatccatattcaagaaggggatttgttaataacaaaagatggaactgttggtaaagttgctttggtacaaaatacaccaggtaaagtttcaattaatagcggaatattgctaataagaaatacaaagattaattatgataataaatttttgtactatacactgctttctgaagagtttaaagtttggttttataatacgaaacctgaaaatagtacgatattacatttatatcagaatcaattttataattttaaatttgcttttccaactatagatgagcaaaaaaaaataattgactatcttgaccaaaaagttgctaaaattcaaaaaattattaagtccaaacaacaacaaattaaccaactaactgagtacaaaaactctcttatttttgaatacgtaacaggtaaaaaacaagtaaaagaggcgaattaa

SEQ ID NO: 332 - protein, 429 aa, Lactobacillus salivarius
MVKMKDSGIEWIGEIPETWEKVKFNAIYSNRNTKVSDREYAPLSVTKKGIVPQLATAAKTNDNDNRKLVKSGDFVINSRSDRRGSCGISSLDGSVSLINTVLEPKNSQMEPLYFDFLFHTIQFADEFYKWGHGIVDDLWTTNWNDMKNITLILPTRFEQQLIADFLDHKTAEIDGLIDKINTEIDTLKQYQSSVITQAVTKGLDPNVPMKDSGIEWIGEIPEAWRTIAIKYTSWLKGRIGWQGLTSDEYINDGPYLITGTDFKNGMINWESCVHISEERFEQDADIHIQEGDLLITKDGTVGKVALVQNTPGKVSINSGILLIRNTKINYDNKFLYYTLLSEEFKVWFYNTKPENSTILHLYQNQFYNFKFAFPTIDEQKKIIDYLDQKVAKIQKIIKSKQQQINQLTEYKNSLIFEYVTGKKQVKEAN

SEQ ID NO: 333 - DNA, 1206 bp, Lactobacillus salivarius
gtgttccctactcaatttactagtgctagtttcacttgggagcgtaaaaagcttggggatgttgcaaattcatatataaatggtggtactccagatactcaaaataagaactattggattggagatattccttggatacaaagttcagatttaaaaaatgatgatatttggaatgtcaacattaataagtatataactaacaaagcagtgaatgacagtgccgcaaagttaatacctgccaattcaatagctattgtgactcgtgtaggagttggaaaattagcttatatgtcccaagaatacagcactagtcaagacttcctatctcttgttgatataaaagaagatttaatttttataatgtatatgctttattttaaaatatctaaagtatcaagttcattacaaggaacatctattaaaggaatcactaaaaaagaattattaaacttatcaattagtattgtcaataacactgccgaacaaaatagaattggtcaagtttttaagattctagataatagtatcaatttacatgaggattacttacaactactgtatgattttagatcttttttattacaaaagatgttttctattaatgatacatttccaaatttaaggtttaaacaatttaatgataaatggaaatataaaaaacttggagaagtagcagatattgtaagtgggggcacgcctgatacaacaaaacacgactattggaatggatctattaattggtatactcctgcagaagttggtaataagatttttgtaagtgatagtcaaagaaaaataacaaatataggcttagaaaatagctcagcaaaaatattacctgtaggaacagtattatttacatcacgtgccggtattgggaaaactgctatcttaaaggaaaaaggttcaactaatcaaggatttcagtcaatagtacccaaacaaaaatttttagattcttactttattttttcaatgtctaacatattaaaaaaatacggtgaatcacatggtgcagggtcaactttcctagagatatctggaaaagaattagcaaaggcaaggatatctcttccttcaataactgaacaaaaaaatatatccaaggtactttttaagttagatactattattactttgcaaaaacaggaaatagataatttaaagaaattaaagcaatttttacttcaaaatatgttcatctaa

SEQ ID NO: 334 - protein, 401 aa, Lactobacillus salivarius
MFPTQFTSASFTWERKKLGDVANSYINGGTPDTQNKNYWIGDIPWIQSSDLKNDDIWNVNINKYITNKAVNDSAAKLIPANSIAIVTRVGVGKLAYMSQEYSTSQDFLSLVDIKEDLIFIMYMLYFKISKVSSSLQGTSIKGITKKELLNLSISIVNNTAEQNRIGQVFKILDNSINLHEDYLQLLYDFRSFLLQKMFSINDTFPNLRFKQFNDKWKYKKLGEVADIVSGGTPDTTKHDYWNGSINWYTPAEVGNKIFVSDSQRKITNIGLENSSAKILPVGTVLFTSRAGIGKTAILKEKGSTNQGFQSIVPKQKFLDSYFIFSMSNILKKYGESHGAGSTFLEISGKELAKARISLPSITEQKNISKVLFKLDTIITLQKQEIDNLKKLKQFLLQNMFI

SEQ ID NO: 335 - DNA, 1119 bp, Lactobacillus salivarius
gtgtctattggcaatattatcattccaattaaaataatattgctaaatcattttttttacgatatttgggagcgtaaagagttaaataatatccttaaaattaattcaggacgtgattataagcaattaaattctggtagtattccagtttatggcactggtggatacatgttaagtgtaaatgataaattatcagataccgatgcagtaggtattggaagaaaaggaacaatagataaacctttatacttaaaggcccccttttggacagttgataccttattttattgcacatctaaagaaaattctgatgtcaaattcatctatttactttttcaaataattaattggaaaaggtatgatgaatccactggagttccaagtttatccaaaaatactatttcaaatataaaaacatatgtaccaaaaattaaagagcaagactatatctctaaattattctttagtctagataacactctccagttacatgaacgaaagtatgaagaattaaccctaattaagaaagctttacttcaaaaacttttccctaaaaaagatggatttaagccagaagttcgctataaaaattttaatgatgcttgggaacagcgaaagttgggggaagtggttgaaagatttgacaatttgagaattccagtaacatcttcaaaacgtgaaaaaggaattactccatattatggagctaatggaatacaggattacgttcagggttatacacatgatggcgagttcgtattagttgcagaagatggtgccaatgatttacagaactatcctgttcattacgtaaatggaaaagtttgggtcaataatcatgcgcatgttcttcaaggtaagaataagatggttgacaatttattcctcgtaaatgcaattaaacaaataaaaattgaaacttatttagtaggaggaagtagagcaaaattaaatgcagacgtaatgatgaaattacctatcaaagtaccaacatttaatgagcaacaaaggttaggtaaatattttgctagactggactctctcatcactcttcatcaatgtaagcttgaaaaactaaaacaattgaaaaaattcttactacaaaatatgtttatataa

SEQ ID NO: 336 - protein, 372 aa, Lactobacillus salivarius
MSIGNIIIPIKIILLNHFFYDIWERKELNNILKINSGRDYKQLNSGSIPVYGTGGYMLSVNDKLSDTDAVGIGRKGTIDKPLYLKAPFWTVDTLFYCTSKENSDVKFIYLLFQIINWKRYDESTGVPSLSKNTISNIKTYVPKIKEQDYISKLFFSLDNTLQLHERKYEELTLIKKALLQKLFPKKDGFKPEVRYKNFNDAWEQRKLGEVVERFDNLRIPVTSSKREKGITPYYGANGIQDYVQGYTHDGEFVLVAEDGANDLQNYPVHYVNGKVWVNNHAHVLQGKNKMVDNLFLVNAIKQIKIETYLVGGSRAKLNADVMMKLPIKVPTFNEQQRLGKYFARLDSLITLHQCKLEKLKQLKKFLLQNMFI

SEQ ID NO: 337 - DNA, 1155 bp, Lactobacillus salivarius
atggcaaaagaagaaaaaaaggctccaaaactccgatttaatgggtatactaacgattgggagcgtaaaaagcttggggaaataggatctgtttctatgaataaacgcatatttaaagatgaaacgtccaccattggagaaattcctttttataaaataggaacttttggaggaaaagcagatgcattcattactcgaaaaaaatatgaagaatacaagaagaaatatccttatcctcaaaaaggaaatctactaatttcggcatcaggtagtattggtagaatcattgaatacaatggtgaagaagcatattatcaagattctaacatcgtctggttagatcacgataatactattttagatgtttttctaaaacctacatatgagattataaaatgggacggaattgaaggtaccactataaagagactatataacaaaaacattcttaatactgtaatttataagcctactattgacgaacaaagaaaaataggaaaattatttatcattttaaataacactattcagttacatgaacgaaagtatgaagaattaaccctaattaagaaagctttacttcaaaaacttttccctaaaaaagatggatttaagccagaagttcgctataaaaattttaatgatgcttgggaacagcgaaagttgggagaagttattatttcagaacataaaggaaaagtaaaatcaataatgaaaggtggtaatactaattatttggaaacaaattatctaaatggtggtactgcacaaaaagttgatgcaatagctgatgtaagtaaggatgatgttcttattctttgggatggttctaaggctggaactatttatcatggatttgaaggtgcattaggttctaccttaaaagcatatgttcctaaatacagtggtgatttcctttatcaaattttaaagaaaaatcaagataaaatatatcaaagctataggacacctaatataccacacgtaataaaaaattttactgaaaagtttaatgtatcaatacctactattatagaacaacaagaaataggtgatttcttcaaacaactagactccctcatcactcttcatcgacgtaagctcgaaaaattaaagcaactaaaaaaattcttactacaaaatatgttcatttaa

SEQ ID NO: 338 - protein, 384 aa, Lactobacillus salivarius
MAKEEKKAPKLRFNGYTNDWERKKLGEIGSVSMNKRIFKDETSTIGEIPFYKIGTFGGKADAFITRKKYEEYKKKYPYPQKGNLLISASGSIGRIIEYNGEEAYYQDSNIVWLDHDNTILDVFLKPTYEIIKWDGIEGTTIKRLYNKNILNTVIYKPTIDEQRKIGKLFIILNNTIQLHERKYEELTLIKKALLQKLFPKKDGFKPEVRYKNFNDAWEQRKLGEVIISEHKGKVKSIMKGGNTNYLETNYLNGGTAQKVDAIADVSKDDVLILWDGSKAGTIYHGFEGALGSTLKAYVPKYSGDFLYQILKKNQDKIYQSYRTPNIPHVIKNFTEKFNVSIPTIIEQQEIGDFFKQLDSLITLHRRKLEKLKQLKKFLLQNMFI

SEQ ID NO: 339 - DNA, 1113 bp, Lactobacillus amylovorus
atggaatataagcatttaaagaatattgctcaaataacaatggggcaatccccgaagtccgaaacttataataataagaaggaaggactacctttttttcaagggaatgctgattttggtgaaataagtcctaaagttaggatttggtgtagtgttcccaaaaaagttgctcataaaaatgatattttaatttctgttagagcacctataggtgctttaaatattgcagatactgaatgttgtattggtcgagggctagctgcaataagcgtaagaaatattaaagatagagactatatttttaatgctttgaaggcaaaaagtgaatatttaaagaataggggaaccggcagcacatttaaagctataaataagaatattttagaagatgtagaaatcccaatagtctctacagaaaaacgagatatagagataaaggttttaaataaattaaatatcgtaaaaaagcaaaaagaaaaagagttgtccaaattagatactctaatcaaagcccgatttgtcgagatgtttggtgatataaagaataataaaaactataattacaaaccaatatctgatttaacaaacgtggtaagtggtggtactccaaaacgagatgttaaggaatactgggatagaggtactatcccgtgggttaaaaccactgagttaaagaataataaagtgaattcaactgaagaatatattactaaaacaggattacaaaattcttctgccaaacttgttccatctcatactattttgatagctatgtatggacaaggaaaaacgagaggaatgactgcatatttggagaaggaagcggctaccaatcaggcttgtgcttgtatacttccttcttccaaaattaattctgaatatttgtggcaatatcttattatgtcatacgaagaattaaggaatctggcaaaaggaggaaatcagccaaatttaaatagccgtatgataaaagattttccaatattggatcctcctatttctcttcagaataaatttgtctctttcatacatcaagtcgacaaatcaaaagttgttaacaacttaataatgaaatatattataagtatagattttatttgctcacttatataa

SEQ ID NO: 340 - protein, 370 aa, Lactobacillus amylovorus
MEYKHLKNIAQITMGQSPKSETYNNKKEGLPFFQGNADFGEISPKVRIWCSVPKKVAHKNDILISVRAPIGALNIADTECCIGRGLAAISVRNIKDRDYIFNALKAKSEYLKNRGTGSTFKAINKNILEDVEIPIVSTEKRDIEIKVLNKLNIVKKQKEKELSKLDTLIKARFVEMFGDIKNNKNYNYKPISDLTNVVSGGTPKRDVKEYWDRGTIPWVKTTELKNNKVNSTEEYITKTGLQNSSAKLVPSHTILIAMYGQGKTRGMTAYLEKEAATNQACACILPSSKINSEYLWQYLIMSYEELRNLAKGGNQPNLNSRMIKDFPILDPPISLQNKFVSFIHQVDKSKVVNNLIMKYIISIDFICSLI

SEQ ID NO: 341 - DNA, 1209 bp, Lactobacillus amylovorus
atgagtaataaagaggaaagaaaggcaccggtattaagatttaagggcttcactgacgattgggaacaacgtaagttagatgatactattactcacaaaagtggtacgtctatcgaaaaatatttttcctcaaaagggctgtacaaggttatttctattggtagctatggatcaaatggaaaatatattgatcagggaatacgtgctgcggctaatgagaagacgaattctcatttaataaaaaaaggcgaactgtcaatggttctaaacgataaaaccggtggaaaaatcataggaagagtattactaatcgaaaaaaataatcaatatgttgttaatcaaagatcggaaatcataaaactctcaacatctctttgggacccacaatttgcatttacatatttaaatggtccttttagaaaaaaagtattacgcataatgcaaggtggtacacaaaactatgttaattttagttcagtaaaaaagttaacagcttcacttacaagtgtgaaagaacagaaagaaattggaacactttttcaaaaattagataatattatcattcttcagcaacgaaaattaaaagaattgcagcaagttaagcaaacgttatctcaatttttattaaatggtaatacacacacacgcccaactttacgacttaatggttttgaagatatatggaaagaaaacaaattaaaagatattgcaaaaattagtatgggacaatcgccctctagtaataattataataaaaaaggcaatggaaaaattttgattcaaggaaatgcagatattgataatggaggcattaggcctagggtttggaccactgagataaccaaattggctaataaaaatgatattttgttaacagttagagcacccgttggggagttagcaataacaaatcgtgaagtagtaatcggtagaggaattgctgcgataaaaggtaacaagtttatttataatctgttagttcaaaaaaataaagaacacttttgggatcgcataagcagcggatcaactttcaaatcaattagttctaatgatataaagcaacttaaagtttatataccgtcagaaaaagaagagactttaatagcttctgtattagagactattaaaaataaaattgattttcaaaatgaaagaataaatgtaataaacaaattaaagaaatacttgcttacaaatttatttatttaa

SEQ ID NO: 342 - protein, 402 aa, Lactobacillus amylovorus
MSNKEERKAPVLRFKGFTDDWEQRKLDDTITHKSGTSIEKYFSSKGLYKVISIGSYGSNGKYIDQGIRAAANEKTNSHLIKKGELSMVLNDKTGGKIIGRVLLIEKNNQYVVNQRSEIIKLSTSLWDPQFAFTYLNGPFRKKVLRIMQGGTQNYVNFSSVKKLTASLTSVKEQKEIGTLFQKLDNIIILQQRKLKELQQVKQTLSQFLLNGNTHTRPTLRLNGFEDIWKENKLKDIAKISMGQSPSSNNYNKKGNGKILIQGNADIDNGGIRPRVWTTEITKLANKNDILLTVRAPVGELAITNREVVIGRGIAAIKGNKFIYNLLVQKNKEHFWDRISSGSTFKSISSNDIKQLKVYIPSEKEETLIASVLETIKNKIDFQNERINVINKLKKYLLTNLFI

SEQ ID NO: 343 - DNA, 1086 bp, Lactobacillus amylovorus
atggaggttttattaaagaatataggaacgattatcactggtaatactcctagcaagaaaaatagtaagtattggaattctaatgatatatgttttgtaaaacctgatgttattggcgatggtgttgataatgttaaccagtctaatgagtatatatctaattatgcgagctcgaaagctagaattgttggtaagaatacgattcttataacttgtattggaaatattggaagggtagggattgtttcaaaagaaaaaatagcttttaatcaacaaataagcgcaatagtacctaattgtaaaattaattttagatatttagcctatgtgcttttgttttctaaatctaaattaaatgcgatggcaaattcggcggtagtacctataattaataaaacccagttagaaaattttaaaataaaaatagattccaacttagaacatcaagcgcaaatagttgaagcgcttgataaaattgaagaaatcaaaaggattcaagataaagaaattaaatacttagatactttaatcaaagcccgatttgtcgagatgtttggtgaccctataattaatactaaagatttgtctttggtatctttaggaaagttatgtactttaaaagcaggagaattcacagcggcaaaagaaattcatgcaaataaagataatataaatagatatccctgttttggcggaaatggtgttagaggatatgtagataattacactcatgatggcaattattcactaataggtagacaaggtgccttatgcggaaacgtacaactgactgccggaaaatttcgaaatacagaacatgctattttagtgaagccaaatgttcaagtaaattattactggctgtttatgttacttaaattagaaaaattaaatcgttttagttcaggtgctgctcagcctggattagcggttaaaactttaaataaaatatttattcccatagccgatcttaatctacaaaatgaattcgcatcatttgcccaacaagtcgacaaatcaaaagttgttaacaacttaataatgaaatatattataagtatatattttatttgctcacttatataa

SEQ ID NO: 344 - protein, 361 aa, Lactobacillus amylovorus
MEVLLKNIGTIITGNTPSKKNSKYWNSNDICFVKPDVIGDGVDNVNQSNEYISNYASSKARIVGKNTILITCIGNIGRVGIVSKEKIAFNQQISAIVPNCKINFRYLAYVLLFSKSKLNAMANSAVVPIINKTQLENFKIKIDSNLEHQAQIVEALDKIEEIKRIQDKEIKYLDTLIKARFVEMFGDPIINTKDLSLVSLGKLCTLKAGEFTAAKEIHANKDNINRYPCFGGNGVRGYVDNYTHDGNYSLIGRQGALCGNVQLTAGKFRNTEHAILVKPNVQVNYYWLFMLLKLEKLNRFSSGAAQPGLAVKTLNKIFIPIADLNLQNEFASFAQQVDKSKVVNNLIMKYIISIYFICSLI

SEQ ID NO: 345 - DNA, 1149 bp, Lactobacillus casei
atgctaaataattcagatggtttaagaagagggccatttgggagtgctttaaaaaaagctttttttgttaaagaaagttcttttgttgtctatgagcagcaaaacgcaatttatgatcggtttaatacaagatatcgaatttcagagaagaagtttgcagaacttcataattttgaggtgcttcccggagattttttattaagtggagctggaacgattggaagaattgcaagagttccgaagggtattgaacaaggagtttttaatcaggcattaatccgactcaggattaatgaaagtatgacggattccgagttttttttacaattcattcgatcagatttcatgcaaaaaaatctaacagaaactaatcctggttctgcgattcaaaatttagttcctatgtcagaattaaaaaattggacagttagaatacctgtagttaatgaacaacggaaaattggttctcttctcaaaaaagttgataaccttatcactgcaactcaggataagattggtgctttggaacaagtcaaagagactttatcaaaaaaccttttcgatcaatcgtggcgattcaaagaatactcgactccttggaaggaaaacaaactgaaggatattgtttcagcatattctggaggcacaccatcagcaaacattcgcacgtattatggtggacacattccttttatccgttctgcagaaatccattcttcaactactgctctgacacttactcaagaaggccttaaaaattcttcagcaaagctggttaaaaccggcgacattctgtacgcgttgtacggagcaaacagcggtgatgttgatcgatcaaagattaacggtgcaattaatcaagctattctcgcgatgaggccatcaaaagagaatgattctaactttatattgtttcagctaatgagaatgaaaaacaaaatcgtttcaacgtacttacaagggggtcaaggtaatctttctggaagaattatccttgctttgaatctggatatgccagaatcaacgtctgagcaacggactattggaagatcacttcaactactgtgtgaacttatcagtgtaaatcagtccaaatattctcaacttgagtcactcaaaaaatctctacttcaaaaccttttcgtctga

SEQ ID NO: 346 - protein, 382 aa, Lactobacillus casei
MLNNSDGLRRGPFGSALKKAFFVKESSFVVYEQQNAIYDRFNTRYRISEKKFAELHNFEVLPGDFLLSGAGTIGRIARVPKGIEQGVFNQALIRLRINESMTDSEFFLQFIRSDFMQKNLTETNPGSAIQNLVPMSELKNWTVRIPVVNEQRKIGSLLKKVDNLITATQDKIGALEQVKETLSKNLFDQSWRFKEYSTPWKENKLKDIVSAYSGGTPSANIRTYYGGHIPFIRSAEIHSSTTALTLTQEGLKNSSAKLVKTGDILYALYGANSGDVDRSKINGAINQAILAMRPSKENDSNFILFQLMRMKNKIVSTYLQGGQGNLSGRIILALNLDMPESTSEQRTIGRSLQLLCELISVNQSKYSQLESLKKSLLQNLFV

SEQ ID NO: 347 - DNA, 1296 bp, Lactobacillus casei
atgctatctttattagacaaccttatcgctgcaactcaggataagattgatgctttagaacaagctaaaaaggcgctacttcagcgtctctttgatcagtcgtggcgcttcaaaggttactctgacccgtgggaaaagcgtaagtttaaagatcttgttgtgcgtgtcaacaaaacatcagatgactcgacgataccaagtgttgaatttgaagatatcatttcaaaacaaggacgcttgaataaagatgttcgattaaaaatcaattcaaagcaaggcatatactttgagccgcaagatgttctatttggaaagttacgtccatacttacaaaattggttgttcccaagtttttatggtagagccgttggtgatttctgggtactgagagccaactcaagtgtactttcagagtacttatttgtccttatccaatcacctcgatttcaaatcgttgcaaatatttcttcagggacaaaaatgccaagatcggactggaatactgtttcaaacacttcatttccgataccggttcaaagtgaacagcggaaaatctggcagctttttaatgtattggataaccttatcgctgcaactcaggataagttgagctttcttaagaaaatgaagatgttttttttacaacagatattcccaacaaaaaatcatgatgtgcctcaaattcgttttgacggttttactgatgtctggtcgcattacaagttaggtagtctcatgaggatagacaaggaacaggaggtgaagaaggagctcctaactgatatacaaaagggattctatgttctagcgatgcgaactttctctatggatggttatatcgaccattcaaaaccttattggctaaatcatttggacaatgttagcgatgataagtttcttttgccgcgtgagtttgcaattttagatgctgatatggatgcgaatctgcccaagattgggagagttctgttgaacgctagcagtgaaaagtatttattggcagcgcatgtcagaaagatacaggttaaatcaggaaacgacccaatcttcatctacgctttaatgcgtggaaactcagtgcatgaaaggctaaagctagaagcaaatgggtctatttccaaacgattattggataagaatgtgtacaaacaatctattctcgttccaaatcgttctgagcaatcaagaattggacgtttgttcttccttcttgaaaccaccattacgcttcatcaacaaaaaattaaaatgttaaaacaagtcaaaaaatcatgtcttcaaaatttgtttatttaa

SEQ ID NO: 348 - protein, 431 aa, Lactobacillus casei
MLSLLDNLIAATQDKIDALEQAKKALLQRLFDQSWRFKGYSDPWEKRKFKDLVVRVNKTSDDSTIPSVEFEDIISKQGRLNKDVRLKINSKQGIYFEPQDVLFGKLRPYLQNWLFPSFYGRAVGDFWVLRANSSVLSEYLFVLIQSPRFQIVANISSGTKMPRSDWNTVSNTSFPIPVQSEQRKIWQLFNVLDNLIAATQDKLSFLKKMKMFFLQQIFPTKNHDVPQIRFDGFTDVWSHYKLGSLMRIDKEQEVKKELLTDIQKGFYVLAMRTFSMDGYIDHSKPYWLNHLDNVSDDKFLLPREFAILDADMDANLPKIGRVLLNASSEKYLLAAHVRKIQVKSGNDPIFIYALMRGNSVHERLKLEANGSISKRLLDKNVYKQSILVPNRSEQSRIGRLFFLLETTITLHQQKIKMLKQVKKSCLQNLFI

SEQ ID NO: 349 - DNA, 573 bp, Lactobacillus casei
ttggttgtcgatgtttttgaagctttgcttgctcggaacgcttgggaaaagcgtaagtttaaagatcttgttgtgcgtgtcaacaaaacatcagatgactcgacgataccaagtgttgaatttgaagatatcatttcaaaacaaggacgcttgaataaagatgttcgattaaaaatcaattcaaagcaaggcatatactttgagccgcaagatgttctatttggaaagttacgtccatacttacaaaattggttgttcccaagtttttatggtagagccgttggtgatttctgggtactgagagccaactcaagtgtactttcagagtacttatttgtccttatccaatcacctcgatttcaaatcgttgcaaatatttcttcagggacaaaaatgccaagatcggactggaatactgtttcaaacacttcatttccgataccggttcaaagtgaacagcggaaaatctggcagctttttaatgtattggataaccttatcgctgcaactcaatccagactttctagccttgaattattaaaaaagtccctattacaggacctttttatttga

SEQ ID NO: 350 - protein, 190 aa, Lactobacillus casei
MVVDVFEALLARNAWEKRKFKDLVVRVNKTSDDSTIPSVEFEDIISKQGRLNKDVRLKINSKQGIYFEPQDVLFGKLRPYLQNWLFPSFYGRAVGDFWVLRANSSVLSEYLFVLIQSPRFQIVANISSGTKMPRSDWNTVSNTSFPIPVQSEQRKIWQLFNVLDNLIAATQSRLSSLELLKKSLLQDLFI

SEQ ID NO: 351 - DNA, 1827 bp, Lactobacillus casei
ttggttgtcgatgtttttgaagctttgcttgctcggaacgcttgggaaaagcgtaagttgggggaaatttttaacgtggtaactgattatgttgcgaatggaagttttaagtcattacggcaaagagtctcaacatattcaaatccaaactttgcgtatatgatccgacttcaagacgcaagtaataattggaagggcccctggctttacacagatcaacagagttattctttcttagcaaaaacgaaactaaacccaggagatattcttatgtcgaacgttggcagtgttgggaaattcttccttgttcctgatttagatcgtccaatgacgctcgcaccaaatgcaattctgttaagaagtatgacttactcaacttattttctgtttcaattacttcaaacctcatcaatgactgaaagtatcaatgagaagaccacgcccggtgtacagcaaaaaataaacaagactgatttaaaaaaaatcataaccaatgtacctactttaaatgaatcaagtatggttggacaaatgctatctttattagacaaccttatcgctgcaactcaggataagattgatgctttagaacaagctaaaaaggcgctacttcagcgtctctttgatcagtcgtggcgcttcaaaggttactctgacccgtgggaaaagcgtaagtttaaagatcttgttgtgcgtgtcaacaaaacatcagatgactcgacgataccaagtgttgaatttgaagatatcatttcaaaacaaggacgcttgaataaagatgttcgattaaaaatcaattcaaagcaaggcatatactttgagccgcaagatgttctatttggaaagttacgtccatacttacaaaattggttgttcccaagtttttatggtagagccgttggtgatttctgggtactgagagccaactcaagtgtactttcagagtacttatttgtccttatccaatcacctcgatttcaaatcgttgcaaatatttcttcagggacaaaaatgccaagatcggactggaatactgtttcaaacacttcatttccgataccggttcaaagtgaacagcggaaaatctggcagctttttaatgtattggataaccttatcgctgcaactcaggataagttgagctttcttaagaaaatgaagatgttttttttacaacagatattcccaacaaaaaatcatgatgtgcctcaaattcgttttgacggttttactgatgtctggtcgcattacaagttaggtagtctcatgaggatagacaaggaacaggaggtgaagaaggagctcctaactgatatacaaaagggattctatgttctagcgatgcgaactttctctatggatggttatatcgaccattcaaaaccttattggctaaatcatttggacaatgttagcgatgataagtttcttttgccgcgtgagtttgcaattttagatgctgatatggatgcgaatctgcccaagattgggagagttctgttgaacgctagcagtgaaaagtatttattggcagcgcatgtcagaaagatacaggttaaatcaggaaacgacccaatcttcatctacgctttaatgcgtggaaactcagtgcatgaaaggctaaagctagaagcaaatgggtctatttccaaacgattattggataagaatgtgtacaaacaatctattctcgttccaaatcgttctgagcaatcaagaattggacgtttgttcttccttcttgaaaccaccattacgcttcatcaacaaaaaattaaaatgttaaaacaagtcaaaaaatcatgtcttcaaaatttgtttatttaa

SEQ ID NO: 352 - protein, 608 aa, Lactobacillus casei
MVVDVFEALLARNAWEKRKLGEIFNVVTDYVANGSFKSLRQRVSTYSNPNFAYMIRLQDASNNWKGPWLYTDQQSYSFLAKTKLNPGDILMSNVGSVGKFFLVPDLDRPMTLAPNAILLRSMTYSTYFLFQLLQTSSMTESINEKTTPGVQQKINKTDLKKIITNVPTLNESSMVGQMLSLLDNLIAATQDKIDALEQAKKALLQRLFDQSWRFKGYSDPWEKRKFKDLVVRVNKTSDDSTIPSVEFEDIISKQGRLNKDVRLKINSKQGIYFEPQDVLFGKLRPYLQNWLFPSFYGRAVGDFWVLRANSSVLSEYLFVLIQSPRFQIVANISSGTKMPRSDWNTVSNTSFPIPVQSEQRKIWQLFNVLDNLIAATQDKLSFLKKMKMFFLQQIFPTKNHDVPQIRFDGFTDVWSHYKLGSLMRIDKEQEVKKELLTDIQKGFYVLAMRTFSMDGYIDHSKPYWLNHLDNVSDDKFLLPREFAILDADMDANLPKIGRVLLNASSEKYLLAAHVRKIQVKSGNDPIFIYALMRGNSVHERLKLEANGSISKRLLDKNVYKQSILVPNRSEQSRIGRLFFLLETTITLHQQKIKMLKQVKKSCLQNLFI

SEQ ID NO: 353 - DNA, 717 bp, Lactobacillus crispatus
atgaagactaatactttagattttgatgcacaggctttaagagaaaaaatcttggatttggccatgcgtgggaaactggtgtcacaggatcctaatgatgagccagctagtgtattgcttgagaaaattaaggcggaaaaagaacagctgattaaggaaaagaaaattaagaagagtaagccgcttgctccgattactgatgatgaaaagccttttgatattcccgatagttgggaatgggttagattgggggatgtcattaatttgatttctggacgtgatattcctaaaaagtttcatctcgcaagtaagagtaaagattcagttccttatattacgggagctagcaatatcactgaaaatggagaaatacatatttcagagtggattgatagtcccagtgttgtagtttcaaaaggtacaatcattttatcagttaaaggaactataggtaaaatagctgagcttaatgttgaaaaggcccatattgctaggcaaattatgggaatagacaatgcttttgggttaagcaaggaatatgaaaagttttttcttgaaagctatattcaagaattaaaaaataaggcaaaaagtatgatacctggcatttcacgagatgacttattaatggctgagtttcctttaccaccactatcagagcaaagtcgaatcttctactcaacaatacgcaaaacttcagactttgctgaagtctaa

SEQ ID NO: 354 - protein, 238 aa, Lactobacillus crispatus
MKTNTLDFDAQALREKILDLAMRGKLVSQDPNDEPASVLLEKIKAEKEQLIKEKKIKKSKPLAPITDDEKPFDIPDSWEWVRLGDVINLISGRDIPKKFHLASKSKDSVPYITGASNITENGEIHISEWIDSPSVVVSKGTIILSVKGTIGKIAELNVEKAHIARQIMGIDNAFGLSKEYEKFFLESYIQELKNKAKSMIPGISRDDLLMAEFPLPPLSEQSRIFYSTIRKTSDFAEV

SEQ ID NO: 355 - DNA, 1158 bp, Lactobacillus curvatus
gtggaatttcaatccaaaattaaattaattggtggggcaacaccttttaaagataacccggagtattggaatggaaatatagtctggttgtcgtcacaagaaatcaagaataaatacgtctcaaatggaacatatacgataacaaaaaaggcgattattgataataaaactagaatggtagatgctggaaccccattaattgttactagaagtggaatattagctaagcgatttcctttaagcataccgactattgatgttgcaattaatcaagatatcaaagctttgctttttgatcaatccaaattaaacgtaaatttttttgtcgctgaactccaatcgaaagaagcatatattttaaagaaaatcattaaaaccggaacgactgttcagtctgtaaatctaccggatctaaataaattgattatatcagtggtatctgattttaaagaacaagaaaaaatcggagacttctttcaaaaattggatcatactattgcacttcagcaacgtaagttagatcttcttacaaagttaaaacagggatatttgcaacaattgtttccttctaaagataagtatcttcctagattaagatttaaagaatttaatggtgattggaaacaatgtacgatgggagaaatttttacagagcgaacagagagaagtggagaaggtgaactgatttctgttactataaattcaggtgttgttaaggccagtgagctagacagaaaagataactcgagtaagaacaaatcaaattataaaaaagttgagattggagacattgcatacaattcaatgagaatgtggcaaggtgcgagtggatattctccatacaaaggtattcttagtccggcgtatactgtgattactcctaaaaatgaaattgattcggagttttttgcttatgattttaaacgttttaatatgatacaagcctttaaaagaaactcccaaggtctaacatctgatacttggaatttaaagttccctacactcaaatcaattaagatcaatgttccacattttgatgagcaaagaagaatttctaatactttcaatcaagttgacaacatgttacttcttcaacaaacaaaaatagatcagttaaataaattaaaacaagcttatcttcaaaaactctttccataa

SEQ ID NO: 356 - protein, 385 aa, Lactobacillus curvatus
MEFQSKIKLIGGATPFKDNPEYWNGNIVWLSSQEIKNKYVSNGTYTITKKAIIDNKTRMVDAGTPLIVTRSGILAKRFPLSIPTIDVAINQDIKALLFDQSKLNVNFFVAELQSKEAYILKKIIKTGTTVQSVNLPDLNKLIISVVSDFKEQEKIGDFFQKLDHTIALQQRKLDLLTKLKQGYLQQLFPSKDKYLPRLRFKEFNGDWKQCTMGEIFTERTERSGEGELISVTINSGVVKASELDRKDNSSKNKSNYKKVEIGDIAYNSMRMWQGASGYSPYKGILSPAYTVITPKNEIDSEFFAYDFKRFNMIQAFKRNSQGLTSDTWNLKFPTLKSIKINVPHFDEQRRISNTFNQVDNMLLLQQTKIDQLNKLKQAYLQKLFP

SEQ ID NO: 357 - DNA, 654 bp, Lactobacillus acidipiscis
atgtatgacaatgctttcacctctttctttggtaggataaatgataatttacttgagttccttgatgcaatttttgtaaaaaaattccttaatagttataagcaaaaggatactatctctgacttcgcagaaattactagaggtgcatcaccgagacccattagtaaatatatagttccaactggtagaccatgggtgaaaatttcagatgtaacttctcttacgagtccttttctgagtgaaacaaaggaatatataagtgaggaaggaattcaaaatagtcgtactgtagaacctggagaccttatcttgtctaatagtgcaactcctggtattccaatttttatggacctagaagcttctgttcatgatggatggcttattatccgtaatctaaaaatgatatcgaaggaatggctatatctttactttagacaaatgcgaaaacagctcgttgcacaaagtaatggcagtgtttttaacaatctaaaaactcaaattgttaaagactttcccatgccgttgataacacaagcggaggttgacaactttcaacaaatagtagctcctatttttggagaccttaaggttttacaccatgagaatatacagttaaaggaaatacgagattgccttttgtcaagatacttttaa

SEQ ID NO: 358 - protein, 217 aa, Lactobacillus acidipiscis
MYDNAFTSFFGRINDNLLEFLDAIFVKKFLNSYKQKDTISDFAEITRGASPRPISKYIVPTGRPWVKISDVTSLTSPFLSETKEYISEEGIQNSRTVEPGDLILSNSATPGIPIFMDLEASVHDGWLIIRNLKMISKEWLYLYFRQMRKQLVAQSNGSVFNNLKTQIVKDFPMPLITQAEVDNFQQIVAPIFGDLKVLHHENIQLKEIRDCLLSRYF

SEQ ID NO: 359 - DNA, 1164 bp, Lactobacillus delbrueckii
atgaaagacgaaaaaaaggcccctaaactgcggtttaaaggctttactgacgattgggagcaacgtaagttaggggatgtgtgtgaaccgataacagatagcattgatactcaaaaataccccaacgaagtatttgcagaatatagcatgcctgcattcgatgcatctatgaagccagatattgttttaggttcttcgatgaatagtgttaggaaaataattactagaccatgcttattagtcaacaagctaaacgtgaggaaaaaacggatatggtatgttaaaaaacctaataagaatgcagtctgttcggcagaatttattcctttgcattcagataccgttgatttaactttcttgaatcaagtagccaagagtgaaacttttacaagatatcttgaaaatcactcatctggctcttcaaatagccaaaagcgaattactccacgatcattaatgctttctaagttgcatattccaacaattgaggagcagaagttaattggtaagatctttgaatccctagatcataccatcactttacatgaggaaaagaaacgccaacttgagcgccttaaaagcgctttattgcagaagatgtttgctgatgagagcgggtatcctgttgttaggtttgaaggatttagtgacgagtgggaacagcgtaagttaaaagatgtcgttgaaaagcaaataaaaggtaaggctcaacttgaaaaattagcaccgggagaggttgaatatcttgatacatcaaggttgaatggtggccaagcaatattaactaacggtcttaaagatgtaacgttagatgatattttaattctctgggatggatcaaaagcaggaactgtttatcatggatttgaaggggccttaggctctacactcaaggcttacagaacctctgctaattcaaaatttgtttaccaatatttgaaacgtcaccaagataatatttataacaattatcggacgcctaatataccgcacgtccaaaaagactttctgaatgtatttacgattagcgtacccgtgagtgatgagcaagaaaaaataggttcattctttaaacagctagatgacactatcgatcttcatcaacgtaagttagatttgttgaaagaacagaaaaaaggctttttacaaaagatgttcgtttag

SEQ ID NO: 360 - protein, 387 aa, Lactobacillus delbrueckii
MKDEKKAPKLRFKGFTDDWEQRKLGDVCEPITDSIDTQKYPNEVFAEYSMPAFDASMKPDIVLGSSMNSVRKIITRPCLLVNKLNVRKKRIWYVKKPNKNAVCSAEFIPLHSDTVDLTFLNQVAKSETFTRYLENHSSGSSNSQKRITPRSLMLSKLHIPTIEEQKLIGKIFESLDHTITLHEEKKRQLERLKSALLQKMFADESGYPVVRFEGFSDEWEQRKLKDVVEKQIKGKAQLEKLAPGEVEYLDTSRLNGGQAILTNGLKDVTLDDILILWDGSKAGTVYHGFEGALGSTLKAYRTSANSKFVYQYLKRHQDNIYNNYRTPNIPHVQKDFLNVFTISVPVSDEQEKIGSFFKQLDDTIDLHQRKLDLLKEQKKGFLQKMFV

SEQ ID NO: 361 - DNA, 1206 bp, Lactobacillus delbrueckii
atgaaagatgaaaaaaaggcccctaaactgcggtttaaaggctttactgacgattgggagcaagtaaagtatggggagatatttcaacgaaggtcaaaaatgggtgttagtacacccgctctcccaagcgttgaatacgacgacattaatccagggatgggcactctaaataaggaacctaaaagtaaaggtacaagcaagcgaggaattcacttcaatcctggagatgttctattcgggaaattacgtccttacttaaagaattggctttttgcttgttttgaaggagtggctgttggagacttttgggttctaacatcaagtaagattgatcatggatttacatatagtttaattcaagcacccgaatttcagtatatagctaatttatcatctggttcgaaaatgcctagatctgattggggattggtctcaaatgcaagaacgtttatcccaacaaatctttcagaacaaaaaagtatatcttctgtcttatttggcttagataccgcaatcactttacatgaggaaaagaaacgccaacttgagcgccttaaaagcgctttattgcagaagatgttcgctgacaagagcgggtatccagctgttcggtttaaaggatttgacgacatctgggaccaagaaaaattgaacagtcttgtaagactgcaccggggattaacatattcaccaaataatgttcaagatagtggcattagaattctacgatcttcaaatattttagacggccagtttgtgatgacagatgatgatatatttgtaaaatctagtgtcgtaaatattcctaccgtaaaggacggagatatattgatcactgcagcaaacgggtctattaaattggtaggcaaacatgccataatttcaggaatatcggaaaacaccgcggtttccggtggctttatgttagtcggatcatctcgaataccggatttcgtaaattcattatttgatacatcttggtaccaaagatttattagaaaatatgttacaggtggtaatgggtccatcggaaatctaaagaaaaatgatctcgataaacaatacgtaaaggtaccaacaacaagtgaacaagaacgaattggagagttttttagggaaatagaccagcttatcattaacaatcagattaagcatgaaaaattgttggaactcaaaaaattccttctccaaaatatgttcatatag

SEQ ID NO: 362 - protein, 401 aa, Lactobacillus delbrueckii
MKDEKKAPKLRFKGFTDDWEQVKYGEIFQRRSKMGVSTPALPSVEYDDINPGMGTLNKEPKSKGTSKRGIHFNPGDVLFGKLRPYLKNWLFACFEGVAVGDFWVLTSSKIDHGFTYSLIQAPEFQYIANLSSGSKMPRSDWGLVSNARTFIPTNLSEQKSISSVLFGLDTAITLHEEKKRQLERLKSALLQKMFADKSGYPAVRFKGFDDIWDQEKLNSLVRLHRGLTYSPNNVQDSGIRILRSSNILDGQFVMTDDDIFVKSSVVNIPTVKDGDILITAANGSIKLVGKHAIISGISENTAVSGGFMLVGSSRIPDFVNSLFDTSWYQRFIRKYVTGGNGSIGNLKKNDLDKQYVKVPTTSEQERIGEFFREIDQLIINNQIKHEKLLELKKFLLQNMFI

SEQ ID NO: 363 - DNA, 1236 bp, Lactobacillus delbrueckii
atgaaagacgaaaaaaaggcccctaaactgcggtttaaaggctttactgacgattgggagcagtgtaagttgggggatgtgttttcttttttaaaaaacagcacgctttcacgtagtgaattaaactacgaaagtggtaaatttaaatacatccattatggagatattcttacaaaattcggagatataacagacactcgtaatttttcagttccatttgttacgacccctgaaaaggtcataagacttgaaaaatattttttgcaaaatggtgatgttgtaatcgccgacaccgcagaagacagcatggttggtaaagttacagaaattcaaaatcctgacccctttccaactgtttctggattgcatacaattccgattagaccaaataaagagtttgctgcaggctttcttgggcactatatgaatgcacctttttatcatgatcaactatttaaattgatgcaaggggtcaaagttctttctttatcaaaaagcgctgtaattcagaccaaaattaattccccatcctactgtgagcaaagattaatctcaaggatgattaatttgattgatggaacaatcactttacatgaggaaaagaaacgccaacttgagcgcttaaaaagcgctttactgcagaaaatgtttgctgacaagagcgggtatccacctgttcggtttgagggatttagtgacaagtgggagcaagtaaagtatggagagatatttcaacgaaggtcaaaaatgggtgttagtacgcctactctaccaagcgttgaatacgacgacattaatcccgggatgggtactctaaataaggaaccaaaaagtaaaggtataagcaagcgaggaatttacttcaatccaggagatgttctattcggaaaattacgtccttacttaaagaattggctttttgcttgttttgaaggagtggctgttggagacttttgggttctaacatcaagtaagattgatcatggatttacgtatagtttaattcaaacgccgggatttcaatacatagctaatctatcatctggttcgaaaatgcctagatctgattggggtttggtctcaaatgcaagaacgtttatccccataaatcatttagaacaagaaagaatatcttctgtcttatttggactggatcacgccatcactttatatgagcacaagttagaaattctaaataagataaaaagtttcctcctccaaaatatgtttatatag

SEQ ID NO: 364 - protein, 411 aa, Lactobacillus delbrueckii
MKDEKKAPKLRFKGFTDDWEQCKLGDVFSFLKNSTLSRSELNYESGKFKYIHYGDILTKFGDITDTRNFSVPFVTTPEKVIRLEKYFLQNGDVVIADTAEDSMVGKVTEIQNPDPFPTVSGLHTIPIRPNKEFAAGFLGHYMNAPFYHDQLFKLMQGVKVLSLSKSAVIQTKINSPSYCEQRLISRMINLIDGTITLHEEKKRQLERLKSALLQKMFADKSGYPPVRFEGFSDKWEQVKYGEIFQRRSKMGVSTPTLPSVEYDDINPGMGTLNKEPKSKGISKRGIYFNPGDVLFGKLRPYLKNWLFACFEGVAVGDFWVLTSSKIDHGFTYSLIQTPGFQYIANLSSGSKMPRSDWGLVSNARTFIPINHLEQERISSVLFGLDHAITLYEHKLEILNKIKSFLLQNMFI

SEQ ID NO: 365 - DNA, 1173 bp, Lactobacillus delbrueckii
atgaaagacgaaaaaaaggtccctaaactgcggtttaaaggctttactgacgattgggagcaacgtaagttgggggatgtggcgaatttttccaagggaaccggctattcaaagtcagacttaaaaggaactggatctccaattatcttatatggccgtctgtataccaagtatgaaactataattcgaaatgttgattcatttgtagttccaaaatctggatcagtgtttagcaaaggcggagaagtaatagttccaggatctggtgaaacggctgaagatatttcaatcgcttcagtagttgaaccagcaggtattcttcttggaggagacttgaatattatctaccctaattccgatttagatccaacctttttagcaatcaccatttcaaacggtaagccacactttgatatggcaagacgggcacaaggtaaatcgatagtacatttacataatgctgatctgaaacacatatcactcaaaactccaaatcttagtgagcagaaacgaataagtaaaatttttgaagtccttgatcaaaccatcactttacatgaagaaaagaaacaccaacttgagagccttaaaagcgctttactgcaaaagatgtttgctaacaaaaacggatatccagctgttcggtttgagggatttagtaatgaatgggagcattgtaagctgggggatgtggctgatattacaactggatcacgtaatcaccaagattctgtcacagacggtaaatatcctttctttgttcgttcggacaaagtagagcggcttaatgaatacgactttgatacaaaggctatcttggttccaggtgatggacggattggagaaatttttcattactataacggaaagtttgccttacatcagcgagtatataaagttgacaacttcaacggaattaacgagttgtttttattaggtctattcaaatacagttttaaagaacatgctttaaggctaaacgcacagggaactgtaccatctttgagattgcctatgtttactaattggagcatctcagttcctatgataaccgagcaaaaaagaattggggttttctttcagaaactcgagcaaaccatctctctatatgaccacaaattggaattgctaaaaaaagtgaaaagatcaatgttgcaagcgatgttcatatag

SEQ ID NO: 366 - protein, 390 aa, Lactobacillus delbrueckii
MKDEKKVPKLRFKGFTDDWEQRKLGDVANFSKGTGYSKSDLKGTGSPIILYGRLYTKYETIIRNVDSFVVPKSGSVFSKGGEVIVPGSGETAEDISIASVVEPAGILLGGDLNIIYPNSDLDPTFLAITISNGKPHFDMARRAQGKSIVHLHNADLKHISLKTPNLSEQKRISKIFEVLDQTITLHEEKKHQLESLKSALLQKMFANKNGYPAVRFEGFSNEWEHCKLGDVADITTGSRNHQDSVTDGKYPFFVRSDKVERLNEYDFDTKAILVPGDGRIGEIFHYYNGKFALHQRVYKVDNFNGINELFLLGLFKYSFKEHALRLNAQGTVPSLRLPMFTNWSISVPMITEQKRIGVFFQKLEQTISLYDHKLELLKKVKRSMLQAMFI

SEQ ID NO: 367 - DNA, 1149 bp, Lactobacillus farciminis
atggataagaaaatggtgcctgaggttcgatttaaagggttttctgacgattgggaacagcattcatttcagaacactctaatcatacactctggaaaagattacaaacatttaaataaaggaaatattcccgtatacggcactggcggttatatgctttcagtcgatgaagacctatccaaagtagatggcattggtcttggaagaaaaggtacgatagataaaccacaatatttgaaggcccctttttggacagttgatacattattttatatgacccctaagcctaattttgaaatattattcttatatgcaattgttcaaaaattcaattggaaaaaattgaatgaagcatctggggtaccaagtttatctaagaagactatagaaaaagtaatacaattttaccctgttcaattagaacaaaagaaacttggaattttattaaaaaacattacagaagcggttctcctacaacaacgtcaattagactcctacaacaagcttaaaaaaggattattacaaaagctattccctaaagatggggaaaaggtacctaaagtaagatttactaatttcactggagattgggaacagcataagttaggaatgatggcgcaaatagttcgtggagcttctcccagaccaataaaaagtaaaaagtggtttaatgataaatcaaatattggatggttaagaatttctgatgttacctctcaaaatggaagaataacacatcttacccaaagattgtccgaagcaggtcaaagtaaaaccagaatagttaatactccccatctgcttttaagtattgcagcatcagtagggaaacctgtaataaattacattcccacaggggtacatgatgggtttttaatatttttaaatccaaaatttgaaattgagtatatgtttcaatggttgacttattatcaaaatgaatggaaaaagtacggtcaacctggtagccaaattaatttaaattctgatattattaaaaatcaaagtttgttcattgcaaccatcaccgaacagaaaaaaattgaaaatattttacggcatgtagataagcttattgcccaacaacacaagcaattaaatgaattaaaatctctaaaaaaatatctactgcaaaagctattcatctaa

SEQ ID NO: 368 - protein, 382 aa, Lactobacillus farciminis
MDKKMVPEVRFKGFSDDWEQHSFQNTLIIHSGKDYKHLNKGNIPVYGTGGYMLSVDEDLSKVDGIGLGRKGTIDKPQYLKAPFWTVDTLFYMTPKPNFEILFLYAIVQKFNWKKLNEASGVPSLSKKTIEKVIQFYPVQLEQKKLGILLKNITEAVLLQQRQLDSYNKLKKGLLQKLFPKDGEKVPKVRFTNFTGDWEQHKLGMMAQIVRGASPRPIKSKKWFNDKSNIGWLRISDVTSQNGRITHLTQRLSEAGQSKTRIVNTPHLLLSIAASVGKPVINYIPTGVHDGFLIFLNPKFEIEYMFQWLTYYQNEWKKYGQPGSQINLNSDIIKNQSLFIATITEQKKIENILRHVDKLIAQQHKQLNELKSLKKYLLQKLFI

SEQ ID NO: 369 - DNA, 1071 bp, Lactobacillus helveticus
atgaataaaaaagaggtgaaaaaggctccagcactgcgttttaagggcttcactaacgattgggaagagcgtaagttaggtgattttattgatgttaagtctggaaaagactacaaacatctgaattcgggatcaatacctgtctatggaactggtggatatatgctaagtgtagatagagcgctatcagatatagatgccattgggatcggaaggaaagggacaattgataagccttatttattaaaagcgcctttttggactgtcgataccttgttttacgctgttcctaaacaaaatattgaccttcaattttcactatctatttttaaaaaaataaattggaaaaaatttgatgaatctactggtgtacctagtttatcgaaaactgtaattaatagtgtgggtgcttctgttcccagttatgaagaacaacaaaaaataggttcattcttcaaacaactcgacaaaactatcgctcttcatcaacgaaaattagaaagttttcagtttacttatcacgaaataattaggcgactttttttaaaaaaagcaaagtggcagctaaccaaattatctgatttagtaactattttagataaaaatagaaaaccagttaaaaaagaagacagattacttggcgatactccatattatggagctaatggaattcaagactatatcagcggatttactcataaaggagaatttatacttatagctgaagatggagctaacagtttaacagaataccctatttattttgtcaaaggtcaaatttgggttaataatcatgcacatgttttaaaagtaaatagagatgtaagcccattatttctagctttagcattaaagcagattaattattcaaaatatactgttggaagtagcagaaataaacttaacttaaaagatttagaaaacatagctatatttatacctgacaataatgagcaacaaaaaataggacagttttactctaactatttaaattacctacgtattaataaaaaaagaattcagtatatgaaacaattcaaacaatttcttctccagaatatgttcatttaa

SEQ ID NO: 370 - protein, 356 aa, Lactobacillus helveticus
MNKKEVKKAPALRFKGFTNDWEERKLGDFIDVKSGKDYKHLNSGSIPVYGTGGYMLSVDRALSDIDAIGIGRKGTIDKPYLLKAPFWTVDTLFYAVPKQNIDLQFSLSIFKKINWKKFDESTGVPSLSKTVINSVGASVPSYEEQQKIGSFFKQLDKTIALHQRKLESFQFTYHEIIRRLFLKKAKWQLTKLSDLVTILDKNRKPVKKEDRLLGDTPYYGANGIQDYISGFTHKGEFILIAEDGANSLTEYPIYFVKGQIWVNNHAHVLKVNRDVSPLFLALALKQINYSKYTVGSSRNKLNLKDLENIAIFIPDNNEQQKIGQFYSNYLNYLRINKKRIQYMKQFKQFLLQNMFI

SEQ ID NO: 371 - DNA, 315 bp, Lactobacillus kefiranofaciens
ttggaattggaagaaaaggaaccattgatcaccctcagttacttaaaagcaccattttggactgtagatacactgttttggaatgtccctaaaaatagttatgacatatattttctttattctgtatttcaaaaaatagaatggaaaaaatatgatgaatcaactggtttacctagtttatctaaaacaacaataaataatatcaaagtaaatactacttcatacaatgaacaaaataaaataggacaaattattaaactaattgatcacgctaaattccttcagcaacgaaaattaaaaaaatcaaactattga

SEQ ID NO: 372 - protein, 104 aa, Lactobacillus kefiranofaciens
MELEEKEPLITLSYLKAPFWTVDTLFWNVPKNSYDIYFLYSVFQKIEWKKYDESTGLPSLSKTTINNIKVNTTSYNEQNKIGQIIKLIDHAKFLQQRKLKKSNY

SEQ ID NO: 373 - DNA, 255 bp, Lactobacillus plantarum
atgaaaaacgaaaatttagtgccaaaagtgcggtttaaggggtttagtgacccttgggagcagcgtaagctcggaaactatgtgattattaagtctggagatgcacccagtgagtttgtcgacggagacgaaccatatttaaaggtagatgacttgaataattcaactgtttttcaaaacagtaccaaacatactgttaaggggaatgctgaaaagatgattcagagtgggtcaattgtatttggcagattgtaa

SEQ ID NO: 374 - protein, 84 aa, Lactobacillus plantarum
MKNENLVPKVRFKGFSDPWEQRKLGNYVIIKSGDAPSEFVDGDEPYLKVDDLNNSTVFQNSTKHTVKGNAEKMIQSGSIVFGRL

SEQ ID NO: 375 - DNA, 1158 bp, Lactobacillus reuteri
gtgacaaaatatagacttggagatgtactcactataataatggattatcgtgggaaaactcctaaaaagttaggattagattggacggaagataaaaatgatatagtggcgctaagtgctaaaaacttaaaaaacggggaactaataaacttagataaatctcattatggaaattcagctctttataataaatggatgaaggatggtgatatttcagtaggcgatatcttaatgacttctgaagcgcctctaggggaattatttttagtagataagcctataaaagcaattcttagtcaaagaatattcttacttagaccaaataattcgatagtccttccatggtatctttacttctatatgtcttcaaagaattttcaaaatcgtttaaatggacatgcaacaggtactacagtaataggcataaagcaaaaagaattaagaaatattgaaatagaactcccttctttaagcattcaaaagagcattgtgagaaagttagtaccaattagtaaaaaaatagaaattaacaaggagataaatgctaatttacttgaactaataacgctaatttggtctagatatagtcaaaatattagtaataaggttcctttgaaaaagattgcaaaggatatcgttacaggtaaaacacctagtacaaaaattaaagctaattacgggtcggacataccttttgttaaaattccagacatgcacaacaaagtgtttattgacgagacattacagagcctttctttactaggtgctgattctcaaaaaaataaatatttacctgcaaattcgataatggtcagttgtattggaactcctgggcttgtttcgttaacgggtagcattgcccaaactaatcaacaaattaactcactagttctagatgaaaaatttatttactgggtgtttcttgaacttagatcccttagcaataaaatagggaatcttggcagtggaggtacaactattaaaaatctaaataaatctgattttagcaagctagaggttgtagttcctgataatgatatattattagataaattcaacagtattgctaaaccaatttttgaaagtattcatacgaacagtttcgaaacaaacaaactaaatcaactaaaaaagagattacttcataaattcttttaa

SEQ ID NO: 376 - protein, 385 aa, Lactobacillus reuteri
MTKYRLGDVLTIIMDYRGKTPKKLGLDWTEDKNDIVALSAKNLKNGELINLDKSHYGNSALYNKWMKDGDISVGDILMTSEAPLGELFLVDKPIKAILSQRIFLLRPNNSIVLPWYLYFYMSSKNFQNRLNGHATGTTVIGIKQKELRNIEIELPSLSIQKSIVRKLVPISKKIEINKEINANLLELITLIWSRYSQNISNKVPLKKIAKDIVTGKTPSTKIKANYGSDIPFVKIPDMHNKVFIDETLQSLSLLGADSQKNKYLPANSIMVSCIGTPGLVSLTGSIAQTNQQINSLVLDEKFIYWVFLELRSLSNKIGNLGSGGTTIKNLNKSDFSKLEVVVPDNDILLDKFNSIAKPIFESIHTNSFETNKLNQLKKRLLHKFF

SEQ ID NO: 377 - DNA, 1119 bp, Lactobacillus reuteri; identical to SEQ ID NO: 13

SEQ ID NO: 378 - protein, 372 aa, Lactobacillus reuteri; identical to SEQ ID NO: 14

SEQ ID NO: 379 - DNA, 588 bp, Lactobacillus reuteri; identical to SEQ ID NO: 3

SEQ ID NO: 380 - protein, 195 aa, Lactobacillus reuteri; identical to SEQ ID NO: 4

SEQ ID NO: 381 - DNA, 1176 bp, Lactobacillus rhamnosus; identical to SEQ ID NO: 319

SEQ ID NO: 382 - protein, 391 aa, Lactobacillus rhamnosus; identical to SEQ ID NO: 320

SEQ ID NO: 383 - DNA, 1086 bp, Lactobacillus salivarius
gtgacaaaatataagttgggagaaatcattgaacttaatcctagagaaagcataaaaaaaggaaatattactaggaaaatagcgatggatgatttaggagaatttaaaagagatattgaatcttattcttatagtgaatacaaaggtggaacaaaatttagaaattacgatactttaatggcaagaataacaccttgtttggaaaatggaaaaacttcatttgtaaatattctagaggaaaacgaagtagcttttggttcaactgaatattttgtatttcgtgcgaaacaggacataattaacccttactatttatattatttagtcacaactgataaatttagagaagtagcaattaaatcaatgagtggaacttcaggaagacagagagttcaaaaagatcaaatattagattttagtgttgacttaccttcattagaggatcaagaaaaaataatgaaaccgttaaaattaattgacgataaaataagcttaaatactaaattaaatactaatttactccaattatctcaaattatgtttaagaataaatttcctaatgtaaatgatggtcctgataaaattggagcatacattaggaactatgataaagatagaaaaccactttcaaaaaagcaacgtagtaaaatgccaggtaaatatagatatataggagcaacttctgtaaatgattatattgctaagtataattttgatggtatttatttattgcttggagaagacggaactgttcaagatataaacgggtatcccgttttacaatatattcatggtaaattttggcctaataatcatgctcatgttttacaaggaaataaagtttcaacagagtggttatacctatttttccttcaaagaaatatagaaggcattattacaggggcagttcagaaaaaaatatcgcaaaaaaatttaaactcgttatctgtaactatgccaaacaatgaagaactttctaagtttgataacattattcaaccaatctttgaacaaataagaacattagaagaagaaaacgaaaggttattggagataaagaaagaactactgactaaccttttctaa

SEQ ID NO: 384 - protein, 361 aa, Lactobacillus salivarius
MTKYKLGEIIELNPRESIKKGNITRKIAMDDLGEFKRDIESYSYSEYKGGTKFRNYDTLMARITPCLENGKTSFVNILEENEVAFGSTEYFVFRAKQDIINPYYLYYLVTTDKFREVAIKSMSGTSGRQRVQKDQILDFSVDLPSLEDQEKIMKPLKLIDDKISLNTKLNTNLLQLSQIMFKNKFPNVNDGPDKIGAYIRNYDKDRKPLSKKQRSKMPGKYRYIGATSVNDYIAKYNFDGIYLLLGEDGTVQDINGYPVLQYIHGKFWPNNHAHVLQGNKVSTEWLYLFFLQRNIEGIITGAVQKKISQKNLNSLSVTMPNNEELSKFDNIIQPIFEQIRTLEEENERLLEIKKELLTNLF

SEQ ID NO: 385 - DNA, 1128 bp, Lactobacillus salivarius
atgartrrtactccagatactcaaaataagaactattggattggagatattccttggatacaaagttcagatttaaaaaatgatgatatttggaatgtcaacattaataagtatataactaacaaagcagtgaatgacagtgccgcaaagttaatacctgccaattcaatagctattgtgactcgtgtaggagttggaaaattagcttatatgtcccaagaatacagcactagtcaagacttcctatctcttgttgatataaaagaagatttaatttttataatgtatatgctttattttaaaatatctaaagtatcaagttcattacaaggaacatctattaaaggaatcactaaaaaagaattattaaacttatcaattagtattgtcaataacactgccgaacaaaatagaattggtcaagtttttaagattctagataatagtatcaatttacatgaggattacttacaactactgtatgattttagatcttttttattacaaaagatgttttctattaatgatacatttccaaatttaaggtttaaacaatttaatgataaatggaaatataaaaaacttggagaagtagcagatattgtaagtgggggcacgcctgatacaacaaaacacgactattggaatggatctattaattggtatactcctgcagaagttggtaataagatttttgtaagtgatagtcaaagaaaaataacaaatataggcttagaaaatagctcagcaaaaatattacctgtaggaacagtattatttacatcacgtgccggtattgggaaaactgctatcttaaaggaaaaaggttcaactaatcaaggatttcagtcaatagtacccaaacaaaaatttttagattcttactttattttttcaatgtctaacatattaaaaaaatacggtgaatcacatggtgcagggtcaactttcctagagatatctggaaaagaattagcaaaggcaaggatatctcttccttcaataactgaacaaaaaaatatatccaaggtactttttaagttagatactattattactttgcaaaaacaggaaatagataatttaaagaaattaaagcaatttttacttcaaaatatgttcatctaa

SEQ ID NO: 386 - protein, 375 aa, Lactobacillus salivarius
MNDTPDTQNKNYWIGDIPWIQSSDLKNDDIWNVNINKYITNKAVNDSAAKLIPANSIAIVTRVGVGKLAYMSQEYSTSQDFLSLVDIKEDLIFIMYMLYFKISKVSSSLQGTSIKGITKKELLNLSISIVNNTAEQNRIGQVFKILDNSINLHEDYLQLLYDFRSFLLQKMFSINDTFPNLRFKQFNDKWKYKKLGEVADIVSGGTPDTTKHDYWNGSINWYTPAEVGNKIFVSDSQRKITNIGLENSSAKILPVGTVLFTSRAGIGKTAILKEKGSTNQGFQSIVPKQKFLDSYFIFSMSNILKKYGESHGAGSTFLEISGKELAKARISLPSITEQKNISKVLFKLDTIITLQKQEIDNLKKLKQFLLQNMFI

SEQ ID NO: 387 - DNA, 456 bp, Lactobacillus sakei
atgatatttagtgactttattgagttgcaccgtggatatgacttaccaaaggcaaaacgaaacgcagacggattagtacctgttattgctgcgggaggatatgacggatttcatgatgccgccaaggttcaaggtcctggggtaataactggacgatcaggtacgttagggagcgtttattttaacaccacggatttttggccattaaataccacgttgtttgtgtcaaattttaaagggaacgatccgctatttgtttattactacctgaaaacaatggatttaggacggtatgcgacgggtacgacagtacctacgttgaatagaaaccatttagatcaaattaaggtaaatattccagatttagctcaacaacgggaaattgccaataagttgaatttatttgacgaaaagataagtatgttgaacgacataaatgataatttagcagcttaa

SEQ ID NO: 388 - protein, 151 aa, Lactobacillus sakei
MIFSDFIELHRGYDLPKAKRNADGLVPVIAAGGYDGFHDAAKVQGPGVITGRSGTLGSVYFNTTDFWPLNTTLFVSNFKGNDPLFVYYYLKTMDLGRYATGTTVPTLNRNHLDQIKVNIPDLAQQREIANKLNLFDEKISMLNDINDNLAA

SEQ ID NO: 389 - DNA, 1035 bp, Lactobacillus amylovorus
ttgataaagaaatttgatgaagtatttgttgataaaactagattgggtaagaaaatacctaaagaagaatataagaaaaaaggtaaatacattattatagatcagggtaaagataaaattgctggttttactgataatgaagatggaattttcacagacgtaccaacgattatttttggtgatcatactcgaataataaaatatattgataaaccatttttcttaggtgcagatggagtaaaagtattaaagagcaaaattaataatgctaattataagtatctatattatgctttgaaagcagcatacataccaaacactggatataatcgtcattttaaatggttaaagaaggtaagtattaactacccttcttttgaaaaacaaaaacgaattgttaaattattagataatttaagtgaagtgaaaaataagaaaaatgaagaacttaaattatgtgataccttaatcaaagcccgatttgtcgagatgtttggtgaccctataattaatactaaagatttgtctttggtatctttaggaaagttatgtactttaaaagcaggagaattcacagcggcaaaagaaattcatgcaaataaagataatataaatagatatccctgttttggcggaaatggtgttagaggatatgtagataattacactcatgatggcaattattcactaataggtagacaaggtgccttatgcggaaacgtacaactgactgccgggaaatttcgaaatacagaacatgctattttagtgaagccaaatgttcaagtaaattattactggctgtttatgttacttaaattagaaaaattaaatcgttttagttcaggtgctgctcagcctggattagcggttaaaactttaaataaaatatttattcccatagccgatctaaatctacaaaatgaattcgcatcatttgcccaacaagtcgacaaatcaaaagttgcaattcaaaagtcattagatgaaactcaaactttattcgatagtttaatgcaaaagtactttagttaa

SEQ ID NO: 390 - protein, 344 aa, Lactobacillus amylovorus
MIKKFDEVFVDKTRLGKKIPKEEYKKKGKYIIIDQGKDKIAGFTDNEDGIFTDVPTIIFGDHTRIIKYIDKPFFLGADGVKVLKSKINNANYKYLYYALKAAYIPNTGYNRHFKWLKKVSINYPSFEKQKRIVKLLDNLSEVKNKKNEELKLCDTLIKARFVEMFGDPIINTKDLSLVSLGKLCTLKAGEFTAAKEIHANKDNINRYPCFGGNGVRGYVDNYTHDGNYSLIGRQGALCGNVQLTAGKFRNTEHAILVKPNVQVNYYWLFMLLKLEKLNRFSSGAAQPGLAVKTLNKIFIPIADLNLQNEFASFAQQVDKSKVAIQKSLDETQTLFDSLMQKYFS

SEQ ID NO: 391 - DNA, 1119 bp, Lactobacillus amylovorus
atgaaggaaggaataccgtttatttctgttgaagctattgtaaataataaaatagattttaaaaggaaacgtggatatatctctaacgaatataatgaaaaatgtaatcagaagtataaaccacaaaaaaatgatgtatatttagtaaaatcaggttcaactgtaggtaaaacagcaattgttgaaacaaatattcctttcaatatttggtctccattagcagcattgcggccaaataatgcaacttctccatattttttattctatttattgcaaacagataatttgcaaagtcaagtcattaataaatctaaaggtggtactcagcccaatttaagtatgaggcttcttgaacactttaaaatttttgtacctaataatattgattatcaaacccaaatagcacgattacttataaacgtggataaaattatttcacttcagcaacgaaaattaaatgaactaaaagaagtaaagaaaacacttctatcacagcttttcccatctaaagggcagtatagaccaataataagatttaagaagtttactaataaatggaccaaaagaaaattagggaatattgccaaaataattggaggcggaacaccctctacaagtaatcatgattattggaatggaaatataaactggtattctccaaccgaaataggcaataatatatttgtaaattcaagtaataaaaaaatctcaataaaaggattaaataatagttctgccaaattattacccggtggcaaaactatattatttacttcacgtgctgggattggaaatatggcaatcatgttaacagatggttgtactaaccaaggatttcaatcttgggtaattgatgatacgaaaattgatatatattttttatattctttaggtagattattaaaacacgacgctattagacaagcttccggttcaacttttttagagatttcaaataaagaagtaaaaaaactattactagaaattccatcatttactgaacaaaaattaataggtaatatgcttagaaaaatagatgatgatattgtaaggcaaaaagaacgtattatattaattaccaaaatcaaaaaaaatcttcttcaaaaattatttgtttaa

SEQ ID NO: 392 - protein, 372 aa, Lactobacillus amylovorus
MKEGIPFISVEAIVNNKIDFKRKRGYISNEYNEKCNQKYKPQKNDVYLVKSGSTVGKTAIVETNIPFNIWSPLAALRPNNATSPYFLFYLLQTDNLQSQVINKSKGGTQPNLSMRLLEHFKIFVPNNIDYQTQIARLLINVDKIISLQQRKLNELKEVKKTLLSQLFPSKGQYRPIIRFKKFTNKWTKRKLGNIAKIIGGGTPSTSNHDYWNGNINWYSPTEIGNNIFVNSSNKKISIKGLNNSSAKLLPGGKTILFTSRAGIGNMAIMLTDGCTNQGFQSWVIDDTKIDIYFLYSLGRLLKHDAIRQASGSTFLEISNKEVKKLLLEIPSFTEQKLIGNMLRKIDDDIVRQKERIILITKIKKNLLQKLFV

SEQ ID NO: 393 - DNA, 1101 bp, Lactobacillus amylovorus
ttgataaagaaatttgatgaagtatttgttgataaaactagattgggtaagaaaatacctaaagaagaatataagaaaaaaggtaaatacattattatagatcagggtaaagataaaattgctggttttactgataatgaagatggaattttcacagacgtaccaacgattatttttggtgatcatactcgaataataaaatatattgataaaccatttttcttaggtgcagatggagtaaaagtattaaagagcaaaattaataatgctaattataagtatctatattatgctttgaaagcagcatacataccaaacactggatataatcgtcattttaaatggttaaagaaggtaagtattaactaccttcttttgaaaaaacaaaaacgaattgttaaattattagataatttaagtgaagtgaaaaataagaaaaatgaagaacttaaattatgtgataccttaatcaaagcccgatttgtcgagatgtttggtgacccagggttagttcatcgtgaaaataaagtgtgtaatctagaaaatgtagcagaagtgaggtctagccatcgcatttttacaagagagtttacaaagagtggagttcctttttatagaggaacagagattagtttattagctaatggcaaagagccaattcattcgtattatatttctaaagctagatatgatgaaataactaaaaatgattccaagccaaaaataggagatttattgatgccgtcgatttgtgataaaggtcaaatatggctggttaatactagtaagccattttattacaaggatggtcgtgttttatgtatctcaccaaatagagaaaagttcaatacaatattctttcatcaatatatgaaaatgaagagtcaaattgaatatttaaaaattggaagtggatcaacgtttgcagaatttaagatatttcagctaaagaaattaaaaattaatattccaccgcttaagcttcaaaatgaattcgcctcatttgtccaacaagtcgacaaatcaaaagttgcaattcaaaagtcattagatgaaacgcaaactttattcgatagtttaatgcaaaagtactttagttaa

SEQ ID NO: 394 - protein, 366 aa, Lactobacillus amylovorus
MIKKFDEVFVDKTRLGKKIPKEEYKKKGKYIIIDQGKDKIAGFTDNEDGIFTDVPTIIFGDHTRIIKYIDKPFFLGADGVKVLKSKINNANYKYLYYALKAAYIPNTGYNRHFKWLKKVSINYLLLKKQKRIVKLLDNLSEVKNKKNEELKLCDTLIKARFVEMFGDPGLVHRENKVCNLENVAEVRSSHRIFTREFTKSGVPFYRGTEISLLANGKEPIHSYYISKARYDEITKNDSKPKIGDLLMPSICDKGQIWLVNTSKPFYYKDGRVLCISPNREKFNTIFFHQYMKMKSQIEYLKIGSGSTFAEFKIFQLKKLKINIPPLKLQNEFASFVQQVDKSKVAIQKSLDETQTLFDSLMQKYFS

SEQ ID NO: 395 - DNA, 516 bp, Lactobacillus casei
atgagtaaggatgctaaaaacgttcctacattgcggtttaaggggtattctgacgcttgggaaaagcgtaagttgcgggaagtgagtgacgtgcgagatggaacgcatgcttctcccaaatattacagtcaagggtacccccttgtgacttcgaaaaatctaacctcagcgggtctagatttctcgaatatttcattgatctctgaattagattacaaaaacattaataagcgatctcgtgtagacaaaggtgacattctttttggcatgattggtactattgggacgcctgtaatggtacatgaatcaaattttgcaattaagaatgttgcgcttattaaagaaagagaagctgtactgaacagttttttggttcagttactaaaatctccggcatttattaactatattcgtaatgaaaatgtgggaggaactcaaaagtttctcagcctcaacacgatcagaaattttagattttcttttcccccagtttacaattcaagtgcaacaccctga

SEQ ID NO: 396 - protein, 171 aa, Lactobacillus casei
MSKDAKNVPTLRFKGYSDAWEKRKLREVSDVRDGTHASPKYYSQGYPLVTSKNLTSAGLDFSNISLISELDYKNINKRSRVDKGDILFGMIGTIGTPVMVHESNFAIKNVALIKEREAVLNSFLVQLLKSPAFINYIRNENVGGTQKFLSLNTIRNFRFSFPPVYNSSATP

SEQ ID NO: 397 - DNA, 588 bp, Lactobacillus casei
atgagtaaggatgctaggaatgttcctgcattgcggtttaaggggtattctgacgcttgggaaaagcgtaagtttaaagatcttgttgtgcgtgtcaacaaaacatcagatgactcgacgataccaagtgttgaatttgaagatatcatttcaaaacaaggacgcttgaataaagatgttcgattaaaaatcaattcaaagcaaggcatatactttgagccgcaagatgttctatttggaaagttacgtccatacttacaaaattggttgttcccaagtttttatggtagagccgttggtgatttctgggtactgagagccaactcaagtgtactttcagagtacttatttgtccttatccaatcacctcgatttcaaatcgttgcaaatatttcttcagggacaaaaatgccaagatcggactggaatactgtttcaaacacttcatttccgataccggttcaaagtgaacagcggaaaatctggcagctttttaatgtattggataaccttatcgctgcaactcaatccagactttctagccttgaattattaaaaaagtccctattacaggacctttttatttga

SEQ ID NO: 398 - protein, 195 aa, Lactobacillus casei
MSKDARNVPALRFKGYSDAWEKRKFKDLVVRVNKTSDDSTIPSVEFEDIISKQGRLNKDVRLKINSKQGIYFEPQDVLFGKLRPYLQNWLFPSFYGRAVGDFWVLRANSSVLSEYLFVLIQSPRFQIVANISSGTKMPRSDWNTVSNTSFPIPVQSEQRKIWQLFNVLDNLIAATQSRLSSLELLKKSLLQDLFI

SEQ ID NO: 399 - DNA, 1281 bp, Lactobacillus casei
atgagtaaggatgctaggaatgttcctgcattgcggtttaaggggtattctgacgcttgggaaaagcgtaagttgggggaaatttttaacgtggtaactgattatgttgcgaatggaagttttaagtcattacggcaaagagtctcaacatattcaaatccaaactttgcgtatatgatccgacttcaagacgcaagtaataattggaagggcccctggctttacacagatcaacagagttattctttcttagcaaaaacgaaactaaacccaggagatattcttatgtcgaacgttggcagtgttgggaaattcttccttgttcctgatttagatcgtccaatgacgctcgcaccaaatgcaattctgttaagaagtatgacttactcaacttattttctgtttcaattacttcaaacctcatcaatgactgaaagtatcaatgagaagaccacgcccggtgtacagcaaaaaataaacaagactgatttaaaaaaaatcataaccaatgtacctactttaaatgaatcaagtatggttggacaaatgctatctttattagacaaccttatcgctgcaactcaggataagttgagctttcttaagaaaatgaagatgttttttttacaacagatattcccaacaaaaaatcatgatgtgcctcaaattcgttttgacggttttactgatgtctggtcgcattacaagttaggtagtctcatgaggatagacaaggaacaggaggtgaagaaggagctcctaactgatatacaaaagggattctatgttctagcgatgcgaactttctctatggatggttatatcgaccattcaaaaccttattggctaaatcatttggacaatgttagcgatgataagtttcttttgccgcgtgagtttgcaattttagatgctgatatggatgcgaatctgcccaagattgggagagttctgttgaacgctagcagtgaaaagtatttattggcagcgcatgtcagaaagatacaggttaaatcaggaaacgacccaatcttcatctacgctttaatgcgtggaaactcagtgcatgaaaggctaaagctagaagcaaatgggtctatttccaaacgattattggataagaatgtgtacaaacaatctattctcgttccaaatcgttctgagcaatcaagaattggacgtttgttcttccttcttgaaaccaccattacgcttcatcaacaaaaaattaaaatgttaaaacaagtcaaaaaatcatgtcttcaaaatttgtttatttaa

SEQ ID NO: 400 - protein, 426 aa, Lactobacillus casei
MSKDARNVPALRFKGYSDAWEKRKLGEIFNVVTDYVANGSFKSLRQRVSTYSNPNFAYMIRLQDASNNWKGPWLYTDQQSYSFLAKTKLNPGDILMSNVGSVGKFFLVPDLDRPMTLAPNAILLRSMTYSTYFLFQLLQTSSMTESINEKTTPGVQQKINKTDLKKIITNVPTLNESSMVGQMLSLLDNLIAATQDKLSFLKKMKMFFLQQIFPTKNHDVPQIRFDGFTDVWSHYKLGSLMRIDKEQEVKKELLTDIQKGFYVLAMRTFSMDGYIDHSKPYWLNHLDNVSDDKFLLPREFAILDADMDANLPKIGRVLLNASSEKYLLAAHVRKIQVKSGNDPIFIYALMRGNSVHERLKLEANGSISKRLLDKNVYKQSILVPNRSEQSRIGRLFFLLETTITLHQQKIKMLKQVKKSCLQNLFI

SEQ ID NO: 401 - DNA, 588 bp, Lactobacillus casei; identical to SEQ ID NO: 397

SEQ ID NO: 402 - protein, 195 aa, Lactobacillus casei; identical to SEQ ID NO: 398

SEQ ID NO: 403 - DNA, 693 bp, Lactobacillus crispatus
ttggcaatgcgcggaaaattagtcgagcaagatccccatgatgaacctgcaagtgttttgttgaaaaagatcaaagctgagaaggagcaacttattaaagaaggcaagattaagaaaagtaagccgcttccaccgattactgacgatgagaagccgttcgatattcctaatggttgggaatgggttagattgggggatattggagcatgggcagctggtgcgactccatctcgtaaacattctgaatactatggaggagatattccttggcttaaaacaggtgatcttaacgatggtattgtggaagaaactagtgagaaaattacagagttaggtgttaaaaattcatccgtaaaaataaacaaacccggtaatatattaattgcaatgtatggtgcaactattggaaaattaggtattgtaggtaaaaaagaattagtaacaaatcaggcatgttgtggttgtaccccttataaaggaatttataatcagtatttgttttattatctcttgtcatcgagaaaaagattaattaatttaggaagcggtggtgcacaaccaaatatttccaaacaaaaaatagaaaagtttgctttcccacttccaccacaatcagaacagagtcgagtcactgctaaaatagaacaactacttccttttcttggtaaggttgaattttctgccgaacaataa

SEQ ID NO: 404 - protein, 230 aa, Lactobacillus crispatus
MAMRGKLVEQDPHDEPASVLLKKIKAEKEQLIKEGKIKKSKPLPPITDDEKPFDIPNGWEWVRLGDIGAWAAGATPSRKHSEYYGGDIPWLKTGDLNDGIVEETSEKITELGVKNSSVKINKPGNILIAMYGATIGKLGIVGKKELVTNQACCGCTPYKGIYNQYLFYYLLSSRKRLINLGSGGAQPNISKQKIEKFAFPLPPQSEQSRVTAKIEQLLPFLGKVEFSAEQ

SEQ ID NO: 405 - DNA, 1182 bp, Lactobacillus curvatus
atgaaagagcaaaaaaagcaaccagaactccggtttaaaggctttactgacgattgggaacagcgtaagtttggggagctgtacaaaaaaaaccttgagcgaaataaagatcattttagttcggacagaacaatttcaattgcgactatgcgttttaagaaagagggtaatggtgcggctgaaaactccctagtatcttataaagttctgcgggaaggcgacattgcttttgaaggtcataccagtaaacgatttgcgtttggccgatttgtgttgaatgacattggagatggcattatgtcaccgcgtttcacgacattacgtccaactcaggatatgcctataaaattctggaaacagtatatccactatgaaccaataatgcgttatccgattgttaactcgacaaaactgggaacaatgatgaatgagttagtcgttgatgagtttttaaatcagcctgtgctggttcctgaactttcagaacaacaaaaaataggttctttcttcaaacaactcgacaacactatcacccttcagcagcgtaagttggagcttcttaagaaaatgaaacggggacatttacaacaaatgtttccttctacaggtcagcctactcctcaattaagattcagcaaatttaaaggtgattggaaacaaaataagttaagtggcattgcaaaaattacaatggggcagtcacccaaatcggaaaattacactgacaatcctaatgactggattttagtacaaggtaatgcggatataaaaaatggtgaagtctatcccagagtttggacaacacaagtaactaaaattgcacaaaaaggagatttattattaagtgtacgtgcacctgttggagatgtggctaaaacaaaatataccgtagttataggacgaggggttgctagcgttaaaggaacagacttcatttattatttattggagaaaataaaatactcaggatactgggagagaatcagttcagggtcaacatttgaatcaattaactctaatgatgttaaagaagcaaaattttacgtcccaaaagaaataactgaacaaaagaaaattggaaatttttttcaaaaactcgatcaaactataacactccagcagtctaaagtggaaaaactaaaaattttaaaacaatcttatctccaaaaactcttcccttaa

SEQ ID NO: 406 - protein, 393 aa, Lactobacillus curvatus
MKEQKKQPELRFKGFTDDWEQRKFGELYKKNLERNKDHFSSDRTISIATMRFKKEGNGAAENSLVSYKVLREGDIAFEGHTSKRFAFGRFVLNDIGDGIMSPRFTTLRPTQDMPIKFWKQYIHYEPIMRYPIVNSTKLGTMMNELVVDEFLNQPVLVPELSEQQKIGSFFKQLDNTITLQQRKLELLKKMKRGHLQQMFPSTGQPTPQLRFSKFKGDWKQNKLSGIAKITMGQSPKSENYTDNPNDWILVQGNADIKNGEVYPRVWTTQVTKIAQKGDLLLSVRAPVGDVAKTKYTVVIGRGVASVKGTDFIYYLLEKIKYSGYWERISSGSTFESINSNDVKEAKFYVPKEITEQKKIGNFFQKLDQTITLQQSKVEKLKILKQSYLQKLFP

SEQ ID NO: 407 - DNA, 549 bp, Lactobacillus delbrueckii
atgagaaacaaattaggcaacttagtttcttttatctctaaaggaattgctccaaaatatgctgataattcggataagcatgtaatacgagtattaaaccagagatgcaatagaaattctgagataattatagaaaatgcacgctataataatttagacaagaaaaaagttccagaagagcgaatattgaaagaaaatgatatagtgattaattcaactggaaccggaacagcgggaaggatagctcaattaagaaaagaacaattagatgttccaactactgttgatagtcatatgattattttaagggcaaaagatattgatgcaaaatttttaggttattcattaaaagcaaaattgcgtcaattagagagttatgctgaaggttctacaggtcaaacagaaatcaatcgcgaacgactactgaatgaaactatcattgattatccagataatattgatgaacagaggaaattggttcgacaaatagagtgtattgacgaactaattagactgaacaagcgaataaatgataatttagcagcttaa

SEQ ID NO: 408 - protein, 182 aa, Lactobacillus delbrueckii
MRNKLGNLVSFISKGIAPKYADNSDKHVIRVLNQRCNRNSEIIIENARYNNLDKKKVPEERILKENDIVINSTGTGTAGRIAQLRKEQLDVPTTVDSHMIILRAKDIDAKFLGYSLKAKLRQLESYAEGSTGQTEINRERLLNETIIDYPDNIDEQRKLVRQIECIDELIRLNKRINDNLAA

SEQ ID NO: 409 - DNA, 1110 bp, Lactobacillus delbrueckii
cagtgtaagttgggggatgtggcaaaaatcaccatgggtcaatcaccaaattctaaaaattacactgataatccaaaagatcacattctcgttcaaggaaatgcagatatgaaggatggtcaagtacatcctagaatttggactacggaaataacaaaaatcgcagacaaaggtgatttaatcttaagcgttagagcacctgtaggcgatattggaaaaacaagctatgatgtggttatcggtcgtggagtagccgccatcaaaggtaatgaatttatttttcaactgcttaaacgaatgaaaacagtaggttattggactaaatatagtactggttcaacatttgagagcattaattcattagaaataaataatgcggtaataaatctccctaaggagcatgaacaaaatgaggttggaaagatactttcctatatggatcatgccatcactttacatgaggaaaagaaagctaacttggagcgcttaaaaagcgctttactgcagaagttgttcgctgataagagcgggtatccggcagttcggtttaagggctttggtggtaactggaaagagcgaaaatttggtgagcttggaaccatagagatgtgcaaacgaatttttaaagatcaaacaaccgatgctggagaaatccccttctataaaattggaacatttggcgggatgcctaatgcatatatatctagagaaatttttgaaagatataaaagattatatccctatcctacaaagggggatatcttaatttctacttctggtagtattggacgagtcgttgaatacaccggccaagaagcctattatcaagattcaaatatcgtgtggttaaatcacaacgatttaattagtaattcctttttaaagtatctgtacaaaacttttaattggaacggtgttgaaggaagtacgattaaacgtttatacaataacaatatattgaaaacaaagatcagaattccatccagttgtgaacaagagaaaatagggggaattttgtctactctcgatcatcttcttagccatcatcaacaaaaaatagatatagtaaagttaatcaagcaatctctactacaaaacatgttcatctaa

SEQ ID NO: 410 - protein, 369 aa, Lactobacillus delbrueckii
QCKLGDVAKITMGQSPNSKNYTDNPKDHILVQGNADMKDGQVHPRIWTTEITKIADKGDLILSVRAPVGDIGKTSYDVVIGRGVAAIKGNEFIFQLLKRMKTVGYWTKYSTGSTFESINSLEINNAVINLPKEHEQNEVGKILSYMDHAITLHEEKKANLERLKSALLQKLFADKSGYPAVRFKGFGGNWKERKFGELGTIEMCKRIFKDQTTDAGEIPFYKIGTFGGMPNAYISREIFERYKRLYPYPTKGDILISTSGSIGRVVEYTGQEAYYQDSNIVWLNHNDLISNSFLKYLYKTFNWNGVEGSTIKRLYNNNILKTKIRIPSSCEQEKIGGILSTLDHLLSHHQQKIDIVKLIKQSLLQNMFI

SEQ ID NO: 411 - DNA, 1107 bp, Lactobacillus delbrueckii
tgggagcaacgtaagttgggggatgtttgtgaagaagtgtctggaaataatggcaatgtcaaaggtttaccaattttaactatatctgctgcaaatggttggatgaatcaaaaagaccgcttttctcaagtaatcgccggaaatgaattgaaaaagtatactcttttagaaaaaggtcatttagcatataaccatggaaattcaaagctggcaaaatacggaactgtctttgtacagaatctatatgatcaggcactagttcctcgtgtttatcatagcttcaaaatgaagacagagaataatccttattacgtcgagtattattttgccaccaagaaacttgatagagaattggcaagactagtaacatccggggctaggatggatgggttgctcaatattaataagaaagatttcttcaaaatcaagtttgaagtaccaacccctgttgaacaatcattaattagtactatccttcagaagctagatcagatcatcactttacatgaggaaaagaaatgcctacttgagcgcttaaaaagcgttttatcgcaggaaatgtttgctaacaaaaacggatatccagctgttcggtttgagggatttgataaagcatggaaacaaagtaagttaggagaaattactaaagtaatagcagctaaaccttacatatcaacaccttcaacacatggaaattatttagtgatacaacaaggtgataaaccaatcgcgggtttctctaatagtaatccattcaagaattataataatataacattatttggtgaccatacactatccttatttaagcctaggtcaccatttcttgttgcttctgatggaataaaaatattgtcaccatcaatagaaatgaatggtttgttttacttctatgaacttgaaaagtataaacctaaaagtgaaggctataaaaggcactttactattttgaaaaaatgtaaggcaaattttccaacagacattgatgaacagaaactgatcggcagcctattgttgcatatagataatcttatcactaagcagcaactaaagatggataaattgaacgaaacaaaggagtcattgttacaaaacatgttcatctaa

SEQ ID NO: 412 - protein, 368 aa, Lactobacillus delbrueckii
WEQRKLGDVCEEVSGNNGNVKGLPILTISAANGWMNQKDRFSQVIAGNELKKYTLLEKGHLAYNHGNSKLAKYGTVFVQNLYDQALVPRVYHSFKMKTENNPYYVEYYFATKKLDRELARLVTSGARMDGLLNINKKDFFKIKFEVPTPVEQSLISTILQKLDQIITLHEEKKCLLERLKSVLSQEMFANKNGYPAVRFEGFDKAWKQSKLGEITKVIAAKPYISTPSTHGNYLVIQQGDKPIAGFSNSNPFKNYNNITLFGDHTLSLFKPRSPFLVASDGIKILSPSIEMNGLFYFYELEKYKPKSEGYKRHFTILKKCKANFPTDIDEQKLIGSLLLHIDNLITKQQLKMDKLNETKESLLQNMFI

SEQ ID NO: 413 - DNA, 1164 bp, Lactobacillus delbrueckii
ttgggggatgtgtatggtcatttatattccgggaacactcctagcagaaaaaaaagtgcaaattttggcggagataccccttggattagaacggcagatttaaataacggattgattaaaagcgccactgaatttctgacttatgaaggtataaagcaattgaaaatacttccagagaataccattgtcttagcaatgtatggtgggtttaatcaaattgggcgtaccggtattctaggatttcccgctacaatcaaccaagcattagtagctttgactcctcataagaatatcaatcagttctttgctcaatcttacctaaataggcatatcatcgattggcgtcgagtcgcagctagcagtagaaaagatccaaatattactaaagaggatgttgagaaatctgaattttcatttggaagtttggaggagcaaaatcgtatctcaaagcttatttctagactcgaccacaccatcactttacatgaggaaaagaaacgccaacttgagcgcttaaaaagcgctttactgcagaagatgtttgctgatgagagcgggtatcctgttgttaggtttgaaggatttagtgacgagtgggaagagcgtaagttgggtgatatagctcccttacgtggcggttttgcattcaaaagctctaaattcaggaacactggtgtaccaattgttagaatttcaaatattctttccagcggggaggtaggtggagattttgcatattatgatgaacaggataaggatgacaaatatattcttccagataaatcagcagtcctagccatgtcaggtgcaacaacaggtaaggtagctatactatctcaaactgattatgacaaggtctatcaaaaccagcgagttggttattttcagcctgtagactatattgactacgggtttatttccacaatcgtccgttcagaattattcatgatgcaacttgagtctgttctagtttcaggcgctcagccaaatgtatcgtcagaagaaattgattcgtttaattttatgattcccatattagttcaggagcaacaaaaaataggtcagttcttcaaacaattagatgacactatcgctcttcatcagcaaaaaataaataatataaactcagtcaaaaaatcattattacaaaagatgttcatctaa

SEQ ID NO: 414 - protein, 387 aa, Lactobacillus delbrueckii
MGDVYGHLYSGNTPSRKKSANFGGDTPWIRTADLNNGLIKSATEFLTYEGIKQLKILPENTIVLAMYGGFNQIGRTGILGFPATINQALVALTPHKNINQFFAQSYLNRHIIDWRRVAASSRKDPNITKEDVEKSEFSFGSLEEQNRISKLISRLDHTITLHEEKKRQLERLKSALLQKMFADESGYPVVRFEGFSDEWEERKLGDIAPLRGGFAFKSSKFRNTGVPIVRISNILSSGEVGGDFAYYDEQDKDDKYILPDKSAVLAMSGATTGKVAILSQTDYDKVYQNQRVGYFQPVDYIDYGFISTIVRSELFMMQLESVLVSGAQPNVSSEEIDSFNFMIPILVQEQQKIGQFFKQLDDTIALHQQKINNINSVKKSLLQKMFI

SEQ ID NO: 415 - DNA, 1146 bp, Lactobacillus delbrueckii
ttgggggatgtggcgaatttttccaagggaaccggctattcaaagtcagacttaaaaggaactggatctccaattatcttatatggccgtctgtataccaagtatgaaactataattcgaaatgttgattcatttgtagttccaaaatctggatcagtgtttagcaaaggcggagaagtaatagttccaggatctggtgaaacggctgaagatatttcaatcgcttcagtagttgaaccagcaggtattcttcttggaggagacttgaatattatctaccctaattccgatttagatccaacctttttagcaatcaccatttcaaacggtaagccacactttgatatggcaagacgggcacaaggtaaatcgatagtacatttacataatgctgatctgaaacacatatcactcaaaactccaaatcttagtgagcagaaacgaataagtaaaatttttgaagtccttgatcaaaccatcactttacatgaggaaaagaaacagcaacttaaatgcttaaaaagcgctttactgcagaaaatgttcgctaacaagaacaagagtggggatccggatgttcggtttaaaggctttgacgagagatgggaaagacatatactaaatgatttagcgatatttaatccgaaaggtactttgcctacatcgttcgaatacgtagatttgggttctgtgattggagttgaaatgatatcgcataaaacgatctcaaaatttgatgctccatcgagggcacaacgcctagcacaagtaggtgatctcttctatcaaactgtaagaccatatcaacaaaacaattatttgtttgataataaagataatgcttacgttttttcaactggatatgctcaattaagaccattgatagatggttatttcttactttgcctcgtccaaacgaagagttttgtaagaaaagttatgaatgcatgtaccggtacaagctatccagcaataaattcgcaggacttagcacaaattggagttaatattccaattaactctaaagaacagcggttaatcggtaatctttataaggtaattgacaaccttatcacgctttatcaacagaaattagatgacttaaatactatcaagcaatctctattacaaaagatgttcatctaa

SEQ ID NO: 416 - protein, 381 aa, Lactobacillus delbrueckii
MGDVANFSKGTGYSKSDLKGTGSPIILYGRLYTKYETIIRNVDSFVVPKSGSVFSKGGEVIVPGSGETAEDISIASVVEPAGILLGGDLNIIYPNSDLDPTFLAITISNGKPHFDMARRAQGKSIVHLHNADLKHISLKTPNLSEQKRISKIFEVLDQTITLHEEKKQQLKCLKSALLQKMFANKNKSGDPDVRFKGFDERWERHILNDLAIFNPKGTLPTSFEYVDLGSVIGVEMISHKTISKFDAPSRAQRLAQVGDLFYQTVRPYQQNNYLFDNKDNAYVFSTGYAQLRPLIDGYFLLCLVQTKSFVRKVMNACTGTSYPAINSQDLAQIGVNIPINSKEQRLIGNLYKVIDNLITLYQQKLDDLNTIKQSLLQKMFI

SEQ ID NO: 417 - DNA, 1206 bp, Lactobacillus farciminis
ataagttttactattttaacaataattatatttgttattattaaagatttttgtctaataaaaataatcaaaataatcaaatttaatttctacttttttactaaaacttgggaacttcgtaagctaaatgatgtagtatctgtaacaatgggacaatcaccaaaatcttcaaattatacaaacaatcccaaagattatattttagttcaaggaaatactgatattgtggacggttgggtaaaaccaagaatatggacaaaacaaataactaaatctgccaaaaagggaagtacgcttttgagtgtacgagctcctgtgggtgatgttagtagtacaaactatgacattgtcataggtagaggtattgctgcattaagtgagaactcatttatttttcaattattgaaaaaaataaaatcgagtggttattggaataagcttactaccggatctacatttgaatcaattaattcagatgatattaaaaatttgaacttttatattccatttaatatcgccgaacaaaaaaaagtatcagacttactatctttgattgataactcggttgctctacaacaacgtcaattagactcctacaacaagcttaaaaaaggattattacaaaaattattcccgaaagatggggaaagagtacccgaagttagatttgctgattttcatgaagactgggaacagcgaaaactaaaagatttagccaatgttattggaggcggaactccatctacaaaaataggtgagtattggaatggagatatagattggtattctcctgttgaaataggtaaaagtatttttgtaaatcatagtcaaaaaagaataaccaaacttggacttaataaaagttcagcaaaaatattaccaattaatactttactattcacatctcgggcgggtattggaaatactgcaatattaaaaaaagaaggaacaactaatcaaggttttcaatcaatagtacccattaaagataaactggatatatattatttatattcaaattctgataaattgaaaagatatggagaaagagttggtggaggttcaacctttacagaagtatcaggcaaacaaatgaaggaaatgccgattacaatacctaccatacatgaacaaaagaatattggtcatatatttcaattgttagattttcaaatactattacaagaaaataatttaaaaaattaa

SEQ ID NO: 418 - protein, 401 aa, Lactobacillus farciminis
MSFTILTIIIFVIIKDFCLIKIIKIIKFNFYFFTKTWELRKLNDVVSVTMGQSPKSSNYTNNPKDYILVQGNTDIVDGWVKPRIWTKQITKSAKKGSTLLSVRAPVGDVSSTNYDIVIGRGIAALSENSFIFQLLKKIKSSGYWNKLTTGSTFESINSDDIKNLNFYIPFNIAEQKKVSDLLSLIDNSVALQQRQLDSYNKLKKGLLQKLFPKDGERVPEVRFADFHEDWEQRKLKDLANVIGGGTPSTKIGEYWNGDIDWYSPVEIGKSIFVNHSQKRITKLGLNKSSAKILPINTLLFTSRAGIGNTAILKKEGTTNQGFQSIVPIKDKLDIYYLYSNSDKLKRYGERVGGGSTFTEVSGKQMKEMPITIPTIHEQKNIGHIFQLLDFQILLQENNLKN

SEQ ID NO: 419 - DNA, 789 bp, Lactobacillus helveticus
ttgatgaatgctattaagaatttcaacatagagccattcttagttggtggtggacgtgcaaaacttaatgcagatgtcatgatgaaattaaatattctgttaccaacttttgtcgaacaagaaaaaatcggttcattatttagtcttttagataagactatcgctcttcatcaacgaaaattgaaattattaaaagttatgaaaaaagcactatctcaatatatgttttgtcaagagacagaattcgttcctattttaagattcaattcgttttctgataaatggaaatatgaacgtcttaagaagcttataattaaagaaattaaaggtaaagctaaagcagatatgaagggaacaaaatctacttatatcgacactgcattattaaatggtggctccataacaaaagttgattcgcctactgatacatttcacaatgatattattattctttgggatggctcacaggctggaaaaatttatcatgggtttactggtgcattaggatcaactttgaaaagctataaaccaaagtattcaggaggatttttatatcaatatttaaaaagtaaagagcccataatttttttacggtatagaactcccaatattcctcatgtagtaaaggattttactgagatttttaaaataaacgttccaagtgttaaagaacaagaaaaaatttcaaaaacattgaattatttggatcaaagtattttagttgaaactaaaaaaataggctcgattaaaaaaataaaaaaatttttactccaaaacatgttcatctaa

SEQ ID NO: 420 - protein, 262 aa, Lactobacillus helveticus
MMNAIKNFNIEPFLVGGGRAKLNADVMMKLNILLPTFVEQEKIGSLFSLLDKTIALHQRKLKLLKVMKKALSQYMFCQETEFVPILRFNSFSDKWKYERLKKLIIKEIKGKAKADMKGTKSTYIDTALLNGGSITKVDSPTDTFHNDIIILWDGSQAGKIYHGFTGALGSTLKSYKPKYSGGFLYQYLKSKEPIIFLRYRTPNIPHVVKDFTEIFKINVPSVKEQEKISKTLNYLDQSILVETKKIGSIKKIKKFLLQNMFI

SEQ ID NO: 421 - DNA, 357 bp, Lactobacillus kefiranofaciens
ttgggagatgtagcaattttttttaacggaagagcttttagacaaaatgaattactagaaaatggaaagtataaagtccttcgtgtaggaaatttttataccaataattcatggtattattctaatttggagctagacaataaatattatattaacaaaggagacctaatatatacttggtcagcaagttttggtccacacatctggaatggagaaaaagttatttatcattaccatatttggaaaattcaaccttcacaatttattgataaaaattttttaatgcaagtactagaaaatgataaaaataaacttatagcaaatgtaaatggctcgactatggttcataaattgtaa

SEQ ID NO: 422 - protein, 118 aa, Lactobacillus kefiranofaciens
MGDVAIFFNGRAFRQNELLENGKYKVLRVGNFYTNNSWYYSNLELDNKYYINKGDLIYTWSASFGPHIWNGEKVIYHYHIWKIQPSQFIDKNFLMQVLENDKNKLIANVNGSTMVHKL

SEQ ID NO: 423 - DNA, 894 bp, Lactobacillus plantarum
atgtttatggatactaatatgatggctttaactccagtagaaacagacttatatttcctctatttcttgatttcagaagaaaatctatctaaaattgccgatacctccacaatcccccaaataaacaataagcatattattccatatacgatttacttaccatgcctaatggaacaacaacgtttaggaaaagtcttaatattacttagtaaccttatcgctgccaatgaggataaactagaacagttaaaaactctcaaaaagttgatgatgcaaaagattttttctcaggaatggcgcttcaagggattcactgacccatgggagcagcgtaagttaaaatggtttttacgtgtttcaaagttaaaaaatatagatggcatttttgataaaaatagtgtgttatcagtatctggagaatttggtgttgtaaatcagattgcttttcaaggaaggtcatttgcaggaaagtctattttaaattatggaatcttggatcataatgacgttgtttatactaagagtcccttaaaatctaatccttatggaataattaaaactaatttaggcaaggctggtgtggtctctaccctatatgctgtatatgctcctttgaagacagtatactcacccatcctaggttattatttcaatctggatacgcgagttaataactacctacgtcctttagttaataagggtgctaaaaatgatatgaaagtaagagacgaagccgtacttgaaggaaaagtttgtattccagactctatagagacacagaaaaggatttgcaatctattttcgttgattgacaaccttatcgctgccaatgaagataaactaaaccaacttaaagagttgaagaaatatttaatgcaaaatatgtttgtttaa

SEQ ID NO: 424 - protein, 297 aa, Lactobacillus plantarum
MFMDTNMMALTPVETDLYFLYFLISEENLSKIADTSTIPQINNKHIIPYTIYLPCLMEQQRLGKVLILLSNLIAANEDKLEQLKTLKKLMMQKIFSQEWRFKGFTDPWEQRKLKWFLRVSKLKNIDGIFDKNSVLSVSGEFGVVNQIAFQGRSFAGKSILNYGILDHNDVVYTKSPLKSNPYGIIKTNLGKAGVVSTLYAVYAPLKTVYSPILGYYFNLDTRVNNYLRPLVNKGAKNDMKVRDEAVLEGKVCIPDSIETQKRICNLFSLIDNLIAANEDKLNQLKELKKYLMQNMFV

SEQ ID NO: 425 - DNA, 660 bp, Lactobacillus reuteri
ttgaagcaattaaaattatcttttaacaatctgtatttatcactgaccgatgataaaacatttactttaggtgagttgatttttgaaaatatatctggtgactggggaaaagctcaatctcaaggtgattttactaatagagttactatcattcgtggtgctgatatagatgatttagctttgggaaattcggcaaaaactccaataagatatataaaaaatagagctttagttaataaacatttgttgcctaatgatgtgttagtagaaatttcaggcggttcaccaactcaatcaactgggcggtctttacttgtttcagattcagtaattgacaagttcagttcagaagtactaggcactaattttacacggatctttcgtccttcatctgaagaaaacagtatcctatttaagagttatttggactttttgtatgataaagatgttttctttaattatgaaaatggaacaactggtattaagaatttagattataaatctgtattgaagatacaattgccggatattcgaaaagctaataattatcaacaatacattaatctttataagctttataacaataccgttcaaagtaacggtaggcaatctgtacaattaactaaaataagacaagcaatgcttaacaattttttctag

SEQ ID NO: 426 - protein, 219 aa, Lactobacillus reuteri
MKQLKLSFNNLYLSLTDDKTFTLGELIFENISGDWGKAQSQGDFTNRVTIIRGADIDDLALGNSAKTPIRYIKNRALVNKHLLPNDVLVEISGGSPTQSTGRSLLVSDSVIDKFSSEVLGTNFTRIFRPSSEENSILFKSYLDFLYDKDVFFNYENGTTGIKNLDYKSVLKIQLPDIRKANNYQQYINLYKLYNNTVQSNGRQSVQLTKIRQAMLNNFF

SEQ ID NO: 427 - DNA, 1023 bp, Lactobacillus reuteri
gtgaaacttaaagatgtttgtataaaaggtacatcaaatatcaggcaaaaagatgtaaatgatagtggaagatatcctgtctatggagcagctggtccagtgggctttatgaattcttttcaatatgatgaaccatatgttggtgtggtaaaagatggggctggtattggccgagcaacatatttacctagcaattcctcaattattggaaccatgcaggctttgataccaaagaaaaatgtattacccaagtatttgtattacgcagtatcatctatgcatttagaaaaatactattctggtgctactattcctcatatatattttaaaaactataagcacgaaagatttgtattagtttcaaaaaaagaacaagaacaaattatttggagattttctttattagaaaaaatgataagtaataagcaacagcaattgcttaagctggacgaactaatcaaagcccgatttgtcgagatgtttggtgatccgattatcaacaataaaaatataaaaaagaaaaaactaggtgacatttgcttattaaaagctggcgactttaccccttctaaaaaaatatctcctgttaaaacatctattaataagtatccctgctttggaggaaatggtataagaggatatgttgataactatacacatcaaggaaattattctttaattggaagacaaggtgctttatgtggaaatgttaagtttgcaacgggaaaatttagaaatactgaacatgctattttagtaagtccgaatatagagattaacagtcgttggctatttgaactattaaacttggaaaaacttaatcgatttagatctggagcagctcaaccaggtctagcagttaaaacactaaatgagattattgttccagttgcagatttgaattcacaaaacgaatacgcaaactttgttcaacaagtcgacaaatcaaaagttgtaattcaaaaatcgcttgatgagacacaaaaattatatgatagcttaatgcaagaatattttgggtaa

SEQ ID NO: 428 - protein, 340 aa, Lactobacillus reuteri
MKLKDVCIKGTSNIRQKDVNDSGRYPVYGAAGPVGFMNSFQYDEPYVGVVKDGAGIGRATYLPSNSSIIGTMQALIPKKNVLPKYLYYAVSSMHLEKYYSGATIPHIYFKNYKHERFVLVSKKEQEQIIWRFSLLEKMISNKQQQLLKLDELIKARFVEMFGDPIINNKNIKKKKLGDICLLKAGDFTPSKKISPVKTSINKYPCFGGNGIRGYVDNYTHQGNYSLIGRQGALCGNVKFATGKFRNTEHAILVSPNIEINSRWLFELLNLEKLNRFRSGAAQPGLAVKTLNEIIVPVADLNSQNEYANFVQQVDKSKVVIQKSLDETQKLYDSLMQEYFG

SEQ ID NO: 429 - DNA, 636 bp, Lactobacillus reuteri
ttgcttagtagattaaatgataatttagttgaattagttgattcatattttataaatttcctaaataatgtaacaacagtagaaaaaactattgaagatattggtacagtagttggtggtggtactccgtctaaaaaaatagctgcttattggaatggagatattgcttgggtaactcccaaagatctgtctcaacatccgttaatttttacttcaagtggtgaaaattacattacaggtttaggattggcaaaaggaagtgcaaaattattgccaaccaatactatactatttagctctcgagcacctattggttatatttctatagctaaaaataatttagctacaaaccaaggcttcaagtctgtaatccctaataaagaatattcatttcaatttatttatgaattattaaagcacgaaactgctgcaataaaaaatgaagctaatggttctacattcaaagaaatatcaggtaaaaaactcaaacagcatataattaatattcctaattcagaagatacttctaagtttaacgaaattacaaaaccaatttttaaacaattaagaaaattagaagaagaaaacgaaaaattattagcaataaaaaaagagctgttagaaaagtatttttaa

SEQ ID NO: 430 - protein, 211 aa, Lactobacillus reuteri
MLSRLNDNLVELVDSYFINFLNNVTTVEKTIEDIGTVVGGGTPSKKIAAYWNGDIAWVTPKDLSQHPLIFTSSGENYITGLGLAKGSAKLLPTNTILFSSRAPIGYISIAKNNLATNQGFKSVIPNKEYSFQFIYELLKHETAAIKNEANGSTFKEISGKKLKQHIINIPNSEDTSKFNEITKPIFKQLRKLEEENEKLLAIKKELLEKYF

SEQ ID NO: 431 - DNA, 1209 bp, Lactobacillus rhamnosus
atgagtaagggtaccagaaacgttcctgcattaaggtttaaggggttttcggacgcttgggaaaagcgtaagttgattgatcaattgtccttgctaaaagatggaactcatggcacacataaagacggtaactttgcgtttctattaagtgcgaaaaacgtaattcaggattctatagttttcgatgattctgacagaaagatttctgaagatgattttaatgatatttatgccaattatcatataaagaaaaatgatgttcttcttacaattgtcgggacaataggcagagtcgcgcttttcccgaggctgactgttccggtggctttccagcgcagtgtggctattttgcgaacaaagccgacactttttccatactttcttgctttggagttacaaacgccaacaattcaatctaaaatcaaggccagagctaatatgtcagcgcaagcaggaatatacttgggtgatttaaagaaagttgttatatctattccaaaatcagaagaacaaattgaaatagccatgtccttaaaccgattaacaaaccttatcgctgcaactcaaggtaaacttgataaccttgagaagatcaaaagggcgctattaaagcatctctttgaccaatcaatgaggttcagaggttactctgacccgtgggaaaagcgtaagtttggagaactctacaaaccgaataaagagagaaatgagagcgcagaattttcaagtgaaaatacattgtcgatcgcaacaatgacagttaatagaaagggtaatggtgccgccaaaacgtcgcttttaaaatataaggttattcgtataggcgacatagcatttgaaggccacacgagtaaaaagtttgcctttggtcgtttcgttcttaacgatgtggcagacgggattatgtcgcctcgttttacctgcttaagaccaattcatcgacaaattatccaattttggaaacagtatattcattatgaaccaattttgcggcctattctaattcgttctacaaagttaggaacaatgatgaatgaactggttgtcccagacttactaaaacaaaatattcgtgttccgagtatcaacgaacagaaacttattggtaagagtctttctagagttgatgaccttatcgctgcaactcaatccaaactttcaagcctcgaaacattaaaaaaagccctattacaaggacttttcatttga

SEQ ID NO: 432 - protein, 402 aa, Lactobacillus rhamnosus
MSKGTRNVPALRFKGFSDAWEKRKLIDQLSLLKDGTHGTHKDGNFAFLLSAKNVIQDSIVFDDSDRKISEDDFNDIYANYHIKKNDVLLTIVGTIGRVALFPRLTVPVAFQRSVAILRTKPTLFPYFLALELQTPTIQSKIKARANMSAQAGIYLGDLKKVVISIPKSEEQIEIAMSLNRLTNLIAATQGKLDNLEKIKRALLKHLFDQSMRFRGYSDPWEKRKFGELYKPNKERNESAEFSSENTLSIATMTVNRKGNGAAKTSLLKYKVIRIGDIAFEGHTSKKFAFGRFVLNDVADGIMSPRFTCLRPIHRQIIQFWKQYIHYEPILRPILIRSTKLGTMMNELVVPDLLKQNIRVPSINEQKLIGKSLSRVDDLIAATQSKLSSLETLKKALLQGLFI

SEQ ID NO: 433 - DNA, 825 bp, Lactobacillus salivarius
atgttaagtgtaaatgataaattatcagataccgatgcagtaggtattggaagaaaaggaacaatagataaacctttatacttaaaggcccccttttggacagttgataccttattttattgcacatctaaagaaaattctgatgtcaaattcatctatttactttttcaaataattaattggaaaaggtatgatgaatccactggagttccaagtttatccaaaaatactatttcaaatataaaaacatatgtaccaaaaattaaagagcaagactatatctctaaattattctttagtctagataacactctccagttacatgaacgaaagtatgaagaattaaccctaattaagaaagctttacttcaaaaacttttccctaaaaaagatgratttaagccagaagttcgctataaaaatttaagtgatgcttgggaacagcgaaagttgggggaagtggttgaaagatttgacaatttgagaattccagtaacatcttcaaaacgtgaaaaaggaattactccatattatggagctaatggaatacaggattacgttcagggttatacacatgatggcgagttcgtattagttgcagaagatggtgccaatgatttacagaactatcctgttcattacgtaaatggaaaagtttgggtcaataatcatgcgcatgttcttcaaggtaagaataagatggttgacaatttattcctcgtaaatgcaattaaacaaataaaaattgaaacttatttagtaggaggaagtagagcaaaattaaatgcagacgtaatgatgraattatcstatayttattactaa

SEQ ID NO: 434 - protein, 274 aa, Lactobacillus salivarius
MLSVNDKLSDTDAVGIGRKGTIDKPLYLKAPFWTVDTLFYCTSKENSDVKFIYLLFQIINWKRYDESTGVPSLSKNTISNIKTYVPKIKEQDYISKLFFSLDNTLQLHERKYEELTLIKKALLQKLFPKKDEFKPEVRYKNLSDAWEQRKLGEVVERFDNLRIPVTSSKREKGITPYYGANGIQDYVQGYTHDGEFVLVAEDGANDLQNYPVHYVNGKVWVNNHAHVLQGKNKMVDNLFLVNAIKQIKIETYLVGGSRAKLNADVMMELSYIYY

SEQ ID NO: 435 - DNA, 1125 bp, Lactobacillus sakei
atgacaaaagtaaaattaggtgactatgtctcacttcaaacacacaaagttgacaaccttacagccgttaatacgagttacgtttcaacagaaaaccttcaaccaaacagaaacggggtactgttcccagcggcttccgtgccctcttcaggaaaggtgaatttctatgacgtcggagatattcttgtttcaaatattcgtccatacttcaaaaaaatttggatggccattaaccctggtacacactccggtgatgttctgaattttcgcaccaagtcccccaagcttactcaagagtatctatatattgttcttgagagcgactctttttttgactacgttacattaacttcaaaaggcacaaaaatgcctcggggtgacaaggatgccatcatggactttgagttttctttgcccagtcttgatgtacaacaaaaactctccaacaccatcatggcattggagagaaaaattttaatgtctaaacaagtaaatgataatttactcgaattggctgatgctacattcaagaaaaattatgagcagcaagttggtaaccaaaaactagaaacccttgcgacagtcaagggcggaaagcggctaccaaagggggcgccccttaccgaagtaaaaacacagcacccctatttgagaattacagattattcaaagaatggcgtaccatccgtacaatcaatgcaatacatcacggaagaagtgtttgataaaatcagtcgttatgtcattaatgagggtgaggtgttcttatcaatagtcggaactattggaattgttgacttaatcgatgaacggctggacaatgcttctttaactgagaatgcggtaaagattcatgctcaaacgacggctatggcacactatctttatctctatttaagatccgatgaagggcgtcatgagatagactcacgtacagtgggcactactcaaaagaagctggctatcacacgaatcaaagatttcgacgttggtgtgatttctgagacggatttacaagagttcgaacgaactgtcagtccactgattaatatggttttagccaatcgtagcgaaatcgataccttggtacaaattagagactcgcttctacaggagttaatttaa

SEQ ID NO: 436 - protein, 374 aa, Lactobacillus sakei
MTKVKLGDYVSLQTHKVDNLTAVNTSYVSTENLQPNRNGVLFPAASVPSSGKVNFYDVGDILVSNIRPYFKKIWMAINPGTHSGDVLNFRTKSPKLTQEYLYIVLESDSFFDYVTLTSKGTKMPRGDKDAIMDFEFSLPSLDVQQKLSNTIMALERKILMSKQVNDNLLELADATFKKNYEQQVGNQKLETLATVKGGKRLPKGAPLTEVKTQHPYLRITDYSKNGVPSVQSMQYITEEVFDKISRYVINEGEVFLSIVGTIGIVDLIDERLDNASLTENAVKIHAQTTAMAHYLYLYLRSDEGRHEIDSRTVGTTQKKLAITRIKDFDVGVISETDLQEFERTVSPLINMVLANRSEIDTLVQIRDSLLQELI

SEQ ID NO: 437 - DNA, 639 bp, Lactobacillus delbrueckii
atttttaccacgattacgctacaaaatgataatttacttgagttccttgatgcaatttttgtaaaaaaattccttaatagttataagcaaaaggatactatctctgacttcgcagaaattactagaggtgcatcaccgagacccattagtaaatatatagttccaactggtagaccatgggtgaaaatttcagatgtaacttctcttacgagtccttttctgagtgaaacaaaggaatatataagtgaggaaggaattcaaaatagtcgtactgtagaacctggagaccttatcttgtctaatagtgcaactcctggtattccaatttttatggacctagaagcttctgttcatgatggatggcttattatccgtaatctaaaaatgatatcgaaggaatggctatatctttactttagacaaatgcgaaaacagctcgttgcacaaagtaatggcagtgtttttaacaatctaaaaactcaaattgttaaagactttcccatgccgttgataacacaagcggaggttgacaactttcaacaaatagtagctcctatttttggagaccttaaggttttacaccatgagaatatacagttaaaggaaatacgagattgccttttgtcaagatacttttaa

SEQ ID NO: 438 - protein, 212 aa, Lactobacillus delbrueckii
MFTTITLQNDNLLEFLDAIFVKKFLNSYKQKDTISDFAEITRGASPRPISKYIVPTGRPWVKISDVTSLTSPFLSETKEYISEEGIQNSRTVEPGDLILSNSATPGIPIFMDLEASVHDGWLIIRNLKMISKEWLYLYFRQMRKQLVAQSNGSVFNNLKTQIVKDFPMPLITQAEVDNFQQIVAPIFGDLKVLHHENIQLKEIRDCLLSRYF

SEQ ID NO: 439 - DNA, 1185 bp, Lactobacillus delbrueckii
cagtgtaaagcaaaggaattatttgaaagtaaatctaagaaagatcacagtgatttgccagtcctttctgcaactcaagagaatggcatagtttttcgaaatgatttggatatcgacattaaatttgacacacacacggcattgagtaactataaggttgtatcacccggagattacataataagtcttagatcatttcaaggtggatttgaattatcagaaaaacgaggaattatcagccctgcgtatactgtcttcgcatttaataatcaagagaaaaataaacagaatagtactttttggaagtatctttttaagcgatatgatttcattgaatcactaaaaagattaacttttggaatacgagatggcaaagcaatcagctttaatcagtttagtactttaaagctatcttttccgaattttgatgaacaaaataaaattgctacattacttcacgagcttgataggaccatcactttacatgaggaaaagaaatgccaacttgagcgcttaaaaagcgctttactgcagaagttgttcgctgatgagaatggaaatcctgctgttcggtttaaagattttagtgaagcatgggaaagcagaaagttgttcgatgtaattgtaaaaattatcgattttagaggtcgtactcctaaaaaaatgggactgaattggagtgaaagaggacatttggccctctctgccttgaatgtgaaagatgggttcatagatttttctactgatgcacattacgcaaatgaaattctgtataagaaatggatgtctggaaatgaattactaaaggggcaagtactttttacaacagaagctccaatgggaaatgttgcgcaagttccagatgatagtggatatgttttaagtcaaagaacaatttcttttgtttcaaataacagtgaaattacagataattttttagcagtagttttaagatcatcaaaagtacaaagagctctttctacacttgctagtggtggaacggctaaaggagtaagccagagtacactatcacagctaataatggtaattccgatatcattagacgaacaacaaaaaatagaaagaattattaggatagtggaagaacttacacgcctttatcagaataagctagaaattctaacggaactcaagaagtcattgttacaaaaaatgttcatatag

SEQ ID NO: 440 - protein, 394 aa, Lactobacillus delbrueckii
QCKAKELFESKSKKDHSDLPVLSATQENGIVFRNDLDIDIKFDTHTALSNYKVVSPGDYIISLRSFQGGFELSEKRGIISPAYTVFAFNNQEKNKQNSTFWKYLFKRYDFIESLKRLTFGIRDGKAISFNQFSTLKLSFPNFDEQNKIATLLHELDRTITLHEEKKCQLERLKSALLQKLFADENGNPAVRFKDFSEAWESRKLFDVIVKIIDFRGRTPKKMGLNWSERGHLALSALNVKDGFIDFSTDAHYANEILYKKWMSGNELLKGQVLFTTEAPMGNVAQVPDDSGYVLSQRTISFVSNNSEITDNFLAVVLRSSKVQRALSTLASGGTAKGVSQSTLSQLIMVIPISLDEQQKIERIIRIVEELTRLYQNKLEILTELKKSLLQKMFI

SEQ ID NO: 441 - DNA, 567 bp, Lactobacillus kefiranofaciens
atgactgattggaagcaaagaaaagcaccagtactacgttttaaaggcttcactgacgtttgggagcaaagaaagctgggtgaagtagcacaaatagtacgtggagcttcaccgcgacctataaataatcctaaatggtttgattccgaatcaaatattgggtggttaagaatatctgatgtcacttctcaaaagggaaaaatttatcatttagaacaacatatttcgaagttaggacaacaaaaaactagagtagtaacaacaccgcatttacttttaagcatagcagcatctgtaggctatccagtaattaactatgtaccaaccggtgttcatgacggctttattatttttgagaatttaaagcttaatattgattttgggttcttttggttacaaaattttagaccgatttggaaaaaatatggtcaaccaggaagtcaagtaaacttaaatcgttctattgtctctaatacaaaaatttgctttccgtcaaacatagaacaaaggaaggaagatcgtagatcttttgaatcaaatcacaaaattacaatttatgaaccatag

SEQ ID NO: 442 - protein, 188 aa, Lactobacillus kefiranofaciens
MTDWKQRKAPVLRFKGFTDVWEQRKLGEVAQIVRGASPRPINNPKWFDSESNIGWLRISDVTSQKGKIYHLEQHISKLGQQKTRVVTTPHLLLSIAASVGYPVINYVPTGVHDGFIIFENLKLNIDFGFFWLQNFRPIWKKYGQPGSQVNLNRSIVSNTKICFPSNIEQRKEDRRSFESNHKITIYEP

SEQ ID NO: 443 - DNA, 555 bp, Lactobacillus plantarum
ataaacctgaaaacttgggagcagcgtaagttactagaaattgcagatcgtctttcgaaatcatctaatagtgagaatttagcacatgttgaatatgccgatattatatcaggagaggggagacttaaatcggagagtcttattcaaaagcgtaccgatagcaggtcaggtattcaatttgttgctcaaaatgttctttatggtaaattacgcccatatctcaataattggttattcccgaactttcctgggattgcagttggtgacttttgggtttttcaaactaagaagggtatattcgctccgttcttgtacgccctaatacaaagtccaaagtatcagcaagttgctaatatctctacgggaaccaagatgcctaggtctgactggaaaaaggtatctgggatacactttgaagttccaatcgaatttaatgaacaacgaaaaataggtcatttttttctaaggcttgatagccttatcgctgccaatgagtataatttaaaaaacgtcctcagcattcgaggacgttttaatctgcctttattaatgtaa

SEQ ID NO: 444 - protein, 184 aa, Lactobacillus plantarum
MNLKTWEQRKLLEIADRLSKSSNSENLAHVEYADIISGEGRLKSESLIQKRTDSRSGIQFVAQNVLYGKLRPYLNNWLFPNFPGIAVGDFWVFQTKKGIFAPFLYALIQSPKYQQVANISTGTKMPRSDWKKVSGIHFEVPIEFNEQRKIGHFFLRLDSLIAANEYNLKNVLSIRGRFNLPLLM

SEQ ID NO: 445 - DNA, 531 bp, Lactobacillus reuteri
atgaaatatagaatttcagatgtggcaagcataaatgaaagttcgattagtaaaagtacttacataggttcagtaaattatgtagataccagttcagttattagtggtaactttaatggatatcggcattatccaagtatatccgaggcaccaagtagggcaagaagactagtttcaaaagaggacactgttatttctacagtaagacctaatatgaaacacgttgggtttatttctagtaaaagtgactgtatatatagtactggttttgctgttgtgagtcctaaaaaggataagatagatccatattatctatatctttttttgtcatctaatagagtgacagaagttcttcaaagtattggtgaaacgtcaacctcgacttacccctcagttaagccttctgatattggaaatttagttattgatatgcccccattggatgagcaacatttaattgctaatcgaatacgattaattgatgagaaaaagaaccaaaacagccaaataaatgctaatttagctgcctag

SEQ ID NO: 446 - protein, 176 aa, Lactobacillus reuteri
MKYRISDVASINESSISKSTYIGSVNYVDTSSVISGNFNGYRHYPSISEAPSRARRLVSKEDTVISTVRPNMKHVGFISSKSDCIYSTGFAVVSPKKDKIDPYYLYLFLSSNRVTEVLQSIGETSTSTYPSVKPSDIGNLVIDMPPLDEQHLIANRIRLIDEKKNQNSQINANLAA

SEQ ID NO: 447 - DNA, 1128 bp, Lactobacillus reuteri; identical to SEQ ID NO: 1

SEQ ID NO: 448 - protein, 375 aa, Lactobacillus reuteri; identical to SEQ ID NO: 2

SEQ ID NO: 449 - DNA, 534 bp, Lactobacillus salivarius
atgagatatagagtgggagaattagtagatagtatatcgaaaaaatgtgattttaaaactgataaaatcatatttttaaatacaggcgatattgaagacggtaaaattgtgaataacaattgttataaaattagtgatttacctggtcaagcaaagaaaaagataaaaaatggagatattcttttttcagaaataagaccaaaaaataaaagatatgccttagtagaaaatattgatgagacaaactatgtagtttcaactaaattgatggttttaagaaataaagatagcaaagttttaaatatgaaatatttttattattttttaactagtcctaagatgttgagatatctacaatccgaagcagaagcaagatcgggtacatttccacaaattacatttaaggataacatataccctataactattaatttaccaagtttagctgaacaaaataaaatagtgaaaaatattgatagtattgtaaataaaataaaaaataaccagaagataaatactaatttagtagcttag

SEQ ID NO: 450 - protein, 177 aa, Lactobacillus salivarius
MRYRVGELVDSISKKCDFKTDKIIFLNTGDIEDGKIVNNNCYKISDLPGQAKKKIKNGDILFSEIRPKNKRYALVENIDETNYVVSTKLMVLRNKDSKVLNMKYFYYFLTSPKMLRYLQSEAEARSGTFPQITFKDNIYPITINLPSLAEQNKIVKNIDSIVNKIKNNQKINTNLVA

SEQ ID NO: 451 - DNA, 1059 bp, Lactobacillus salivarius
atgaataaacgcatatttaaagatgaaacgtccaccattggagaaattcctttttataaaataggaacttttggaggaaaagcagatgcattcattactcgaaaaaaatatgaagaatacaagaagaaatatccttatcctcaaaaaggaaatctactaatttcggcatcaggtagtattggtagaatcattgaatacaatggtgaagaagcatattatcaagattctaacatcgtctggttagatcacgataatactattttagatgtttttctaaaacctacatatgagattataaaatgggacggaattgaaggtaccactataaagagactatataacaaaaacattcttaatactgtaatttataagcctactattgacgaacaaagaaaaataggaaaattatttatcattttaaataacactattcagttacatgaacgaaagtatgaagaattaaccctaattaagaaagctttacttcaaaaacttttccctaaaaaagatgratttaagccagaagttcgctataaaaattttartgatgcttgggaacagcgraagttgggagaagttattatttcagaacataaaggaaaagtaaaatcaataatgaaaggtggtaatactaattatttggaaacaaattatctaaatggtggtactgcacaaaaagttgatgcaatagctgatgtaagtaaggatgatgttcttattctttgggatggttctaaggctggaactatttatcatggatttgaaggtgcattaggttctaccttaaaagcatatgttcctaaatacagtggtgatttcctttatcaaattttaaagaaaaatcaagataaaatatatcaaagctataggacacctaatataccacacgtaataaaaaattttactgaaaagtttaatgtatcaatacctactattatagaacaacaagaaataggtgatttcttcaaacaactagactccctcatcgcccttcatcagcgtaagctcgaaaaattaaagcaactgaaaaaattcttgttgcaaaatatgttcatttaa

SEQ ID NO: 452 - protein, 352 aa, Lactobacillus salivarius
MNKRIFKDETSTIGEIPFYKIGTFGGKADAFITRKKYEEYKKKYPYPQKGNLLISASGSIGRIIEYNGEEAYYQDSNIVWLDHDNTILDVFLKPTYEIIKWDGIEGTTIKRLYNKNILNTVIYKPTIDEQRKIGKLFIILNNTIQLHERKYEELTLIKKALLQKLFPKKDEFKPEVRYKNFNDAWEQRKLGEVIISEHKGKVKSIMKGGNTNYLETNYLNGGTAQKVDAIADVSKDDVLILWDGSKAGTIYHGFEGALGSTLKAYVPKYSGDFLYQILKKNQDKIYQSYRTPNIPHVIKNFTEKFNVSIPTIIEQQEIGDFFKQLDSLIALHQRKLEKLKQLKKFLLQNMFI

SEQ ID NO: 453 - DNA, 531 bp, Lactobacillus delbrueckii
atgagatatagagttagtgacttagctgacttgaatatacggtctgtatctaagaatgcaaaaggtgttatttattacatcgatacaagtagtgtgtttcaaggacactttagagaagcaaatagatattcagctatagctgatgcaccgagtagggctagaagattggcccaagaaggcgatactgtcatctcaatggttcgcccttcaaatgaacatattggttttatcgattttgatactgacaattatgtcttttcaactggatttgtggtcgttcatccaaatagtgaaatcgtagaacctttttatctatatttattactttcgttagattctactactcgatacttgcaacagattgcagaaacttctactacggcatatccatctgttaaagtggaagatataggtaatttatcgtttgatattcctgagataagcaaacaaagaaaaattgtccataaaattcgcataatagagcaaaagataaagctgaatcaagagataaatgataatttagcagcttaa

SEQ ID NO: 454 - protein, 176 aa, Lactobacillus delbrueckii
MRYRVSDLADLNIRSVSKNAKGVIYYIDTSSVFQGHFREANRYSAIADAPSRARRLAQEGDTVISMVRPSNEHIGFIDFDTDNYVFSTGFVVVHPNSEIVEPFYLYLLLSLDSTTRYLQQIAETSTTAYPSVKVEDIGNLSFDIPEISKQRKIVHKIRIIEQKIKLNQEINDNLAA

SEQ ID NO: 455 - DNA, 495 bp, Lactobacillus plantarum
atgggacaatctccaagttctgcaaactatacaaataatcccgaggatcatatcttagttcagggaaatgccgatatgaaaaatggatacgtattaccccgtgtatggactactcaaataacaaaaaaagcggaagctggagatttgattctttcagtccgagctcccgttggtgatataggtaaaactgattatgacgtagttcttggtcgaggggttgcatcaataaagggtaatgaatttatttatcaaacacttaaatatatgaatgatataggtaagtggactcgctttagtacagggtcaacgtttgaatctattaactcagctgatattaaagatgcaaggattggatatcctaaattaaatgaacaaaatttaataggaaacattttagaaaaaatggacagcattatcgctgccaatgagcaagtcccaaaattagtcattaaaatagtaaagaattctctcgtcaatttattactatttaactaa

SEQ ID NO: 456 - protein, 164 aa, Lactobacillus plantarum
MGQSPSSANYTNNPEDHILVQGNADMKNGYVLPRVWTTQITKKAEAGDLILSVRAPVGDIGKTDYDVVLGRGVASIKGNEFIYQTLKYMNDIGKWTRFSTGSTFESINSADIKDARIGYPKLNEQNLIGNILEKMDSIIAANEQVPKLVIKIVKNSLVNLLLFN

SEQ ID NO: 457 - DNA, 567 bp, Lactobacillus salivarius
atgaaactaaaagaactaataaaaattgaaagtggagtgaataccgttcgcttaaaagataatgagtataaactatatacacttgaagacgtaaattatgacttaggtcatggagaggattataagcatgaagtgagctatagaaaaaatattgtagcaagaggagatatcgtaaccaatacagtaggaaatatgactagcattgtacatactaaaaattctggtaaattgcttaatcaaatttttatgaagttaagtattaataataaagaaatattagatccatggtatttatgctacttattaaatgaatcggaatatatcaaatatcaagaagcaagtattatgggtggatcagtcattaaaaagttgactaaagtaaatcttgaaaatttagaggttaatttaccaactattgatgaacaaagaaaaataggtgaagcgtataaagagactttaagaagatataccttaataatggaaaaagcagagttagaaaagaatttgtatttacaaatgttaggggaaaaagatcttaataataggagtgtagttgaaaatggataa

SEQ ID NO: 458 - protein, 188 aa, Lactobacillus salivarius
MKLKELIKIESGVNTVRLKDNEYKLYTLEDVNYDLGHGEDYKHEVSYRKNIVARGDIVTNTVGNMTSIVHTKNSGKLLNQIFMKLSINNKEILDPWYLCYLLNESEYIKYQEASIMGGSVIKKLTKVNLENLEVNLPTIDEQRKIGEAYKETLRRYTLIMEKAELEKNLYLQMLGEKDLNNRSVVENG

SEQ ID NO: 459 - DNA, 27 bp, ARTIFICIAL
  Artificial DNA Primer
tagtctagactcgaggaattcggtacc

SEQ ID NO: 460 - DNA, 1155 bp, Propionibacterium freudenreichii
atgaacacgcttgccgataacccggtcattatcgaagcgctgcgcacacctattgggactacgggtggtgtgtttgcggatcaaactaccactgatctagcagcgccagtcttgggtgaactcgacgctcggctgcctaccggtactggttttggcgaagttgtgttaggtaacgttcgtgggcctggcggtgatccagcacgtgttgccgctttggctgcagggattgatccagcagtaccagcgttaacattagaccgccagtgcggtagcggtatggcagcaattgagtatgcatggcaccgatgccggtcacaaccaggggtcgttgctgccggaggtgtccaagcggcaagcacacagcctattacattatggcctggccgtgatggtgaaccacccagttcgtttgaccgtgcgccatttgccccacctccgtggttagatcctgatatgggggttatggctgaccgtttagcagctgaacttcacattagtcgtgaacgtcaagatcgttatgcgctgcgctctcatacccgtgcctcaaccgcacgagatgcaggggatttcgatgcggaaatcgtgccaatcgctcgtgtacgtcgtgatcaacgtccacgctcaggttttactatggcacgcttggcacgtttcccagcggcttttcgccctggtggcacggttacggcagcaaatagttgtgggattaacgacgcagcagccgctgtgacgatggtagatgctgctacccatgcgcacttagcaactccaggcttgcgcgtgttagctgcacgtacagttggttatgatccggaccggtttgggttgggcctcgtaccggctgttcgggcagcgcttgacgacgctggtttgggtttggaccaaattgatgcattagagttcaatgaagcgtttgcggctcaagtattggcttgtgcggatgctttggatttggatgagcatcgtctctgtccacgtggcggagcaatttcgctaggtcatccttggggtgcgtccggtgccatcttacttgttcgtctctttagtcgcttggtacgtgaaggcgcaggtcgttacggtttggctgcgatttctattggtggtgggcaaggctctgctgttgttgtcgaggcagtacatccccgtgggaattag

SEQ ID NO: 461 - protein, 384 aa, Propionibacterium freudenreichii
MNTLADNPVIIEALRTPIGTTGGVFADQTTTDLAAPVLGELDARLPTGTGFGEVVLGNVRGPGGDPARVAALAAGIDPAVPALTLDRQCGSGMAAIEYAWHRCRSQPGVVAAGGVQAASTQPITLWPGRDGEPPSSFDRAPFAPPPWLDPDMGVMADRLAAELHISRERQDRYALRSHTRASTARDAGDFDAEIVPIARVRRDQRPRSGFTMARLARFPAAFRPGGTVTAANSCGINDAAAAVTMVDAATHAHLATPGLRVLAARTVGYDPDRFGLGLVPAVRAALDDAGLGLDQIDALEFNEAFAAQVLACADALDLDEHRLCPRGGAISLGHPWGASGAILLVRLFSRLVREGAGRYGLAAISIGGGQGSAVVVEAVHPRGN

SEQ ID NO: 462 - DNA, 1179 bp, Clostridium acetobutylicum
atgaaagaagttgtaatagctagtgcagtaagaacagcgattggatcttatggaaagtctcttaaggatgtaccagcagtagatttaggagctacagctataaaggaagcagttaaaaaagcaggaataaaaccagaggatgttaatgaagtcattttaggaaatgttcttcaagcaggtttaggacagaatccagcaagacaggcatcttttaaagcaggattaccagttgaaattccagctatgactattaataaggtttgtggttcaggacttagaacagttagcttagcagcacaaattataaaagcaggagatgctgacgtaataatagcaggtggtatggaaaatatgtctagagctccttacttagcgaataacgctagatggggatatagaatgggaaacgctaaatttgttgatgaaatgatcactgacggattgtgggatgcatttaatgattaccacatgggaataacagcagaaaacatagctgagagatggaacatttcaagagaagaacaagatgagtttgctcttgcatcacaaaaaaaagctgaagaagctataaaatcaggtcaatttaaagatgaaatagttcctgtagtaattaaaggcagaaagggagaaactgtagttgatacagatgagcaccctagatttggatcaactatagaaggacttgcaaaattaaaacctgccttcaaaaaagatggaacagttacagctggtaatgcatcaggattaaatgactgtgcagcagtacttgtaatcatgagtgcagaaaaagctaaagagcttggagtaaaaccacttgctaagatagtttcttatggttcagcaggagttgacccagcaataatgggatatggacctttctatgcaacaaaagcagctattgaaaaagcaggttggacagttgatgaattagatttaatagaatcaaatgaagcttttgcagctcaaagtttagcagtagcaaaagatttaaaatttgatatgaataaagtaaatgtaaatggaggagctattgcccttggtcatccaattggagcatcaggtgcaagaatactcgttactcttgtacacgcaatgcaaaaaagagatgcaaaaaaaggcttagcaactttatgtataggtggcggacaaggaacagcaatattgctagaaaagtgctag

SEQ ID NO: 463 - DNA, 1179 bp, Clostridium acetobutylicum
atgaaagaggtcgtcattgcatcggctgtgcgtactgctattggttcatacggtaagagtttgaaagacgtaccagcggtcgacttaggcgcaactgccatcaaagaagcagttaagaaagcagggattaagccggaagacgttaacgaagttattctggggaacgtcttgcaagccggtcttggtcaaaatccagcgcgtcaggcatctttcaaagcgggtcttccagtagaaattcctgccatgaccatcaacaaggtatgcggtagtggcctccgtaccgtctctctagctgctcagatcatcaaagcgggagacgccgatgttatcattgctggtggtatggaaaacatgagtcgggcaccctacctagcaaacaacgcacgttggggataccgtatgggtaacgccaaattcgtcgatgaaatgattactgacggcctctgggacgcattcaacgactaccacatgggaatcactgccgaaaacattgccgaacgttggaacattagtcgcgaagaacaagatgagttcgcgttggcgagccaaaagaaagctgaagaagcaatcaaatcaggtcaattcaaagatgaaattgttcctgtggttatcaaaggtcgcaaaggcgaaacggttgtcgacactgacgaacatccgcgtttcggaagtacgatcgaaggactcgcgaagttgaaacctgccttcaagaaggacggcaccgtgacggctggcaacgcaagcggcttaaacgactgcgcagccgtcctcgtcattatgagtgccgagaaagccaaagaactgggtgtgaaaccgctcgccaagattgttagctacggctctgctggtgttgacccagccattatgggttatggccctttctacgctactaaagccgctattgaaaaagccggatggaccgtagacgaacttgacctgattgaatcgaacgaggctttcgctgctcagtccttagccgtagcaaaagacttgaagttcgacatgaacaaagttaacgtaaacggtggtgccattgctttgggacacccgattggtgcctcgggtgctcggatcttagttacgctggttcacgcaatgcaaaagcgtgacgctaagaaagggttggcaacattatgcatcggtggtggacaaggcacagcgatccttcttgaaaagtgctag

SEQ ID NO: 464 - protein, 392 aa, Clostridium acetobutylicum
MKEVVIASAVRTAIGSYGKSLKDVPAVDLGATAIKEAVKKAGIKPEDVNEVILGNVLQAGLGQNPARQASFKAGLPVEIPAMTINKVCGSGLRTVSLAAQIIKAGDADVIIAGGMENMSRAPYLANNARWGYRMGNAKFVDEMITDGLWDAFNDYHMGITAENIAERWNISREEQDEFALASQKKAEEAIKSGQFKDEIVPVVIKGRKGETVVDTDEHPRFGSTIEGLAKLKPAFKKDGTVTAGNASGLNDCAAVLVIMSAEKAKELGVKPLAKIVSYGSAGVDPAIMGYGPFYATKAAIEKAGWTVDELDLIESNEAFAAQSLAVAKDLKFDMNKVNVNGGAIALGHPIGASGARILVTLVHAMQKRDAKKGLATLCIGGGQGTAILLEKC

SEQ ID NO: 465 - DNA, 1170 bp, Lactobacillus brevis
atggcagaagaggttgtgattgttagtgcggcacgtacccctatcggcaagtttggcaaatccttacggggattgagtgcagaacaactaggcaccattgccgctaaagcagcgattactcgtagtggcttagatcctgcgacgattcaacagaccatctttggaagcgtgctgcaagctgggcaaggccaaaacattgcgcgtcagatcgaattgaacgcaggcttaccagtcacttcgaccgcaatgaccattaaccaggtgtgtggctcatccctcaaagctattcgtttgggccagtccgccattttgatgggggatgccgatatcgttcttgtaggtggtacagaatccatgtccaatgcaccttaccttactcctcaaacccgttggggtcataagtttggtgacattacgcttacagattctctcgcccatgatggtttaacagacgcttttacggatatccctatgggaatcacggctgagaacgttgccgcacagttccacatctcacgtgccgaccaggacgcttttgcccttcgttcccaacgtcgtgccacggctgcccagcaagctaatcggtttgccgacgaaattgttcccgtaagcctgggtacaacgactctcacaactgatgaagccgtccggactaccacttcgcgtgagcaactggcagcgttgcgtccagcattcaaaagtgttggcaccgttactgcagggaacgctgcaggcttgaatgacggagccgctgcgatgattctgatgaagaaaagtactgcacgcgctgctgggattgcgtacttggcaacccttcgcggttaccaagaagtcgggattgatccagccatcatgggatatgctccggttacagctattcagcaactccttacgaaaactcagcgcagtgtgtcggatattgaccgttttgaattgaatgaggcttttgcagcccaaagtgttgctgtaggtcaagctctagcattaccagatgaccgcttgaatgttaatggtggtgccattgcactcggtcatcctctaggtgcttccggcacccgtatcgtcgttacattgctgtacgaacttttgcattccgggacccatttgggtgttgcttctatgtgcattggtggtggaatgggaatggcattgatgattgagtcgaattag

SEQ ID NO: 466 - protein, 389 aa, Lactobacillus brevis
MAEEVVIVSAARTPIGKFGKSLRGLSAEQLGTIAAKAAITRSGLDPATIQQTIFGSVLQAGQGQNIARQIELNAGLPVTSTAMTINQVCGSSLKAIRLGQSAILMGDADIVLVGGTESMSNAPYLTPQTRWGHKFGDITLTDSLAHDGLTDAFTDIPMGITAENVAAQFHISRADQDAFALRSQRRATAAQQANRFADEIVPVSLGTTTLTTDEAVRTTTSREQLAALRPAFKSVGTVTAGNAAGLNDGAAAMILMKKSTARAAGIAYLATLRGYQEVGIDPAIMGYAPVTAIQQLLTKTQRSVSDIDRFELNEAFAAQSVAVGQALALPDDRLNVNGGAIALGHPLGASGTRIVVTLLYELLHSGTHLGVASMCIGGGMGMALMIESN

SEQ ID NO: 467 - DNA, 35 bp, Lactobacillus reuteri
agtcaagcttccatggagaaggtttacattgttgc

SEQ ID NO: 468 - DNA, 51 bp, Lactobacillus reuteri
atgcggtaccgaattcctcgagtctagactaaattttcttaagcagaaccg

SEQ ID NO: 469 - DNA, 1179 bp, Lactobacillus reuteri
atggagaaggtttacattgttgctgctcagcgaacaccaatcggtaagtttaacggtcagttagcttcaaagtctgcagttgaattaggagcgattgcaattaaagcggctgttgaaaaggcaaagctcagcgaaaacgatattgaccaagtgttaatggggaatgttattcaagcaggaacgggacaaaatccagcgcgtcaagcatcaatggccgctggattaggtgagcaggttccggcaataacgattaatgacgtctgtgcgtcgggaatgtccagtgttgacctggcagcaagtttgattcgcgcaggacaggctaatgtaattgttgccggggggatggaaagtatgtcccaagctccatatgttcttcctaaggcacggaatggctatcgatttgggaatggaaccttgcttgatgcgatgcaaagtgatgcattaaatgatgtttatggcggttatccgatgggaattactgctgaaaatatcaatgataagtatcagattactcgtcaccaacaagacgaatttgctttgatgagccaccaacgtgcggtaaaggctcaaaaagcaggctatttcgattcagaaattgtaccagttgaagttaagcagaaacgaacaacagtgactgtaactgttgacgaagctccacgaccagatacttcactagcggctttagcaaaattaaaaccagcttttaaatctgacggaagtgtgactgcagggaatgcctcgggaattaatgatggtggagctgccttggttcttgcttctgaaagtgcagtcaaccgattaggattaactccattggctgagtggcaaggatctgcagttgttggtcttgatccagcattgatgggtttgggaccatattatgcaatcaagaagctcttaaaaaatcagcagctgtcggcagatgacgtagatacttacgaaattaatgaggcgtttgcgacccaagcccttgtctgtcagaacttgcttcatcttgatcctagggctgtcaatccttggggtggggcaattgcattaggccatcctgttgggtgttcaggagcacgaattatcgtcacgatgattagtgaaatgcatagggataatcatgaactcggcattgcttcgctgtgtgtcgggggcggaatgggtgaagcggttctgcttaagaaaatttag

SEQ ID NO: 470 - protein, 392 aa, Lactobacillus reuteri
MEKVYIVAAQRTPIGKFNGQLASKSAVELGAIAIKAAVEKAKLSENDIDQVLMGNVIQAGTGQNPARQASMAAGLGEQVPAITINDVCASGMSSVDLAASLIRAGQANVIVAGGMESMSQAPYVLPKARNGYRFGNGTLLDAMQSDALNDVYGGYPMGITAENINDKYQITRHQQDEFALMSHQRAVKAQKAGYFDSEIVPVEVKQKRTTVTVTVDEAPRPDTSLAALAKLKPAFKSDGSVTAGNASGINDGGAALVLASESAVNRLGLTPLAEWQGSAVVGLDPALMGLGPYYAIKKLLKNQQLSADDVDTYEINEAFATQALVCQNLLHLDPRAVNPWGGAIALGHPVGCSGARIIVTMISEMHRDNHELGIASLCVGGGMGEAVLLKKI

SEQ ID NO: 471 - DNA, 29 bp, ARTIFICIAL
  Artificial DNA Primer
ggtaccactattacaaggagattttagtc

SEQ ID NO: 472 - DNA, 1071 bp, Lactobacillus fermentum
atgaaaggtttcgctatgcttggtcccaacaagaccggtttcattgaaaaagaagatcccaaagttggctcgcgtgatgctttggttcgtccgctggcagttgcgccatgcacaagtgatatccacaccgtattcgaagatgcattgggtcctcgggaaaacatgatcttagggcacgaggcttgtggggaaatcgtagaggttggtagcgaagttaaagatttcaaggtaggcgatcgtgtcctgatcccagccattacaccgaactggagtgatgtatactctcaagcaggttacgcaactgatagcgatggtatgttgggaggctggaaattctccaacattaaggatggtgtcttctcaactcgtattcacgttaacgatgcggacggaaacttagctttacttccaaaagagattgatccggcagaagcctgtatgctgagtgacatgattccgacgggtctgcacgcgtttgaaatggcaggagttaccttcggggacgccgtggccgtgattggcgtgggtccagttggtctcatggctttacgtggggctgttttacatggggctggacgcgtattcgcggttggttcacgggagaaaacagtagaagtggcgaagaagtatggtgccaccgacatcattgactaccacaacggtcgcattagcgaccaaattctggaagccacaaacggtcaaggtgttgataaagtattgattgcagggggtaacgccaaagatactttcgaagaagctgtgcggatgctcaaaccgggtggtagcatcggaaacgtcaactacctaaacggtcacgatgatgttgttttcaacgcaggtgactggggtgttggtatgggccacaaaacaattcacggtggcctcatgccaggtggccgtttgcgtatggaaaagttagccgcattggtagtgaatggtcggattgacccctcgctgatgattacacaccgtttcgaaggcttcgagaaaatccctgatgccatcgagctcatgcaccacaaaccagctgatttgatcaaaccggttgtcatttgtaacgatattgattag

SEQ ID NO: 473 - protein, 356 aa, Lactobacillus fermentum
MKGFAMLGPNKTGFIEKEDPKVGSRDALVRPLAVAPCTSDIHTVFEDALGPRENMILGHEACGEIVEVGSEVKDFKVGDRVLIPAITPNWSDVYSQAGYATDSDGMLGGWKFSNIKDGVFSTRIHVNDADGNLALLPKEIDPAEACMLSDMIPTGLHAFEMAGVTFGDAVAVIGVGPVGLMALRGAVLHGAGRVFAVGSREKTVEVAKKYGATDIIDYHNGRISDQILEATNGQGVDKVLIAGGNAKDTFEEAVRMLKPGGSIGNVNYLNGHDDVVFNAGDWGVGMGHKTIHGGLMPGGRLRMEKLAALVVNGRIDPSLMITHRFEGFEKIPDAIELMHHKPADLIKPVVICNDID

SEQ ID NO: 474 - DNA, 36 bp, ARTIFICIAL
  Artificial DNA Primer
gactaagcttgggccctcctcgctcactgactcgct

SEQ ID NO: 475 - DNA, 38 bp, ARTIFICIAL
  Artificial DNA Primer
gactgaattcgggccctcatgaccaaaatcccttaacg

SEQ ID NO: 476 - DNA, 35 bp, ARTIFICIAL
  Artificial DNA Primer
gactgaattcatgatttataaatacttaggagata

SEQ ID NO: 477 - DNA, 37 bp, ARTIFICIAL
  Artificial DNA Primer
gactggatcctaaattagatacaactttattttgtat

SEQ ID NO: 478 - DNA, 35 bp, ARTIFICIAL
  Artificial DNA Primer
gactggatcctagctttgaacaatcaaataaatga

SEQ ID NO: 479 - DNA, 36 bp, ARTIFICIAL
  Artificial DNA Primer
gactcggccgttaaaaatatttcttaagcaaagtct

SEQ ID NO: 480 - DNA, 28 bp, ARTIFICIAL
  Artificial DNA Primer
gactgaattccttcaagataagaagaaa

SEQ ID NO: 481 - DNA, 32 bp, ARTIFICIAL
  Artificial DNA Primer
gactggatccgtagttaaatattcatctttgg

SEQ ID NO: 482 - DNA, 34 bp, ARTIFICIAL
  Artificial DNA Primer
gactggatccagcttaatgcaagaatattttggg

SEQ ID NO: 483 - DNA, 30 bp, ARTIFICIAL
  Artificial DNA Primer
gactcggccgtctgaacttatgtggatgaa

SEQ ID NO: 484 - DNA, 33 bp, ARTIFICIAL
  Artificial DNA Primer
gactgaattcggaaaatcagtaataaagaatac

SEQ ID NO: 485 - DNA, 29 bp, ARTIFICIAL
  Artificial DNA Primer
gactggatccataaagcccactggaccag

SEQ ID NO: 486 - DNA, 32 bp, ARTIFICIAL
  Artificial DNA Primer
gactggatccaaactttgttcaacaagtcgac

SEQ ID NO: 487 - DNA, 34 bp, ARTIFICIAL
  Artificial DNA Primer
gactcggccgagggtattgattatcaataattcg

SEQ ID NO: 488 - DNA, 1115 bp, Lactobacillus reuteri
atgatttataaatacttaggagatattgctgagattaaaggtggcaaaagaatgcctaaaggaactagattgcaacaagaaaaaaatcaacatccgtatttaaggattactgattatgatggtaaaagttttgatcgtaatagtattagatatgttcctgatgaggtgtttgaaaagattagtaactatacagtaacagagggagatatttttttatcaattgttggaactatagggatagcgaccacgattgataaagaatatgataatgctaatctaacagaaaatgcagttaaaataattcctgatgagtcggtaaattccaaatatattttatattttttacaatcgatgttaggacaaagacaaatgaatgaactttctgttggctcaacacaaaaaaagttgcctataaaaaacattaaaaaaatcaagattcttttacctaatttagaaatacaaaataaagttgtatctaatttaggatcctagctttgaacaatcaaataaatgataatttagatgctttattaactaatatattcaaaaaatatatgattaatgacggttttgaaaaatcaaacttaactcaaattgcaaattataaaaatgggttagctatgcaaaagtatagacctaattctaatgaagaaagcttaccagttcttaaaataaaagagttaaatcaaggaaatactgatgattcgtccgatagatgttcggctaatcttgataattctgtaatagttaatactggcgacataattttttcgtggtcaggaactttattagtaaaaaattggacgggagacaaggcaggtcttaatcaacatttatttaaggttacctctaataagtatcctgcatggtttatttatgaatggactaagtatcatttattgaggtttcaagcaattgccgccggaaaagctacaaccatgggtcatatcaaaagaagtgatttaaaatcatcactagtatatattccctctcaattatttttagcgaaaatggatagtcaactagcaccaatttatagtcaaaggttaaacctaattaaagaaaatcaacaattatcgaaacttaagcagactttgcttaagaaatatttttaa

SEQ ID NO: 489 - DNA, 979 bp, Lactobacillus reuteri
cttcaagataagaagaaagaagaaattttttataataaagaaaatcgacattattttcataatgaaatgtttacaggatacgatactgatcaaaccatgcttcgtatcggagctatgaatatgttatctcatggagtggataatcctaatgttgagtatcaagatagtttatctgaacaaaatacggatagagatgaatattctttaattatggctaatcctccatttaagggaagcctagattataattcagtttcaaaagacctgcttaaaatttgtaaaactaaaaaaacagaattactttttgtaactttattcttacaaatgctaaaagtgggtggaagatgtgcctgtattgttccagatggtgttttatttggatcatctaaggcacataagtcaattagaaaagaaataattgaaaataacaatttagaagcagttatttcaatgccttccggagtgtttaagccttatgctggagtttcaactgccatcttgatttttactaagacaggtaatggaggaactgataaagtttggttctatgatatgactgctgatggattttctcttgatgacaagagaacgccagttaaagaaaatgatatacctgatattattgaacgttttaatcatctagataaagaggttgaccgtaaaaagacaaataaatcctttatggttgataagaaagatattgttgacaatgattatgatctttcaattaatcggtataaagaaattgagtataaaccagttaaatatccaccaacagaagagattattgctgaaattgaaaagttagataaggaagcaaatgacgcattacaagagttaaaagctcttttaaaagactagaaaggaaaaacaaattcaggtttgtagggtgattaatggagtataaaaaatttacagcgctttttaccgatgtgactaaaacaggaacaaaaatccccaaagatgaatatttaactac

SEQ ID NO: 490 - DNA, 891 bp, Lactobacillus reuteri
agcttaatgcaagaatattttgggtaaaaaagtggtttaatagtgaaaaactctaaatttgggagattcactatgaatgaaaagtttgttgaaataataaatgagatggccgaagtgcttaatgcctcacagttaaaacgacttcaagaagtaatgttgaagcatttagtagaaagagagccacaaaaacggaaaatcagtaataaagaatacctagcgaagtttttggaagctaaaaaaatggaaggttgctctgatagaacaatcaaatattatcgagttacagttgaacaacttttaaagaaagtagttagaccggtaagaaggattactacagaggaaatgcgtgaatatttggttgattatcaaaagattaataattgtggcaaaacaactattgacaatatcaggcgtaatatttcaagtttcttttcctggcttgaggaagaagactatatattaaagagtcctatgcgtcgtattcataaaattcgggctgaaaagcttgtgaagaatgtaataactgatgaagatattgaaaaacttcgtgatggttgttcttgtttaagagatgtagctataatcgatttattgtattcaacgggtataagagttggggaattggttagacttaacagaactgatattaatttttctgaacgtgagtgtgttgtgtttggaaaaggagataaagaaaggcgagtatattttgatgctaagtcaaaagtgcatttgattaattacttaaggagtagaaatgatgataatcctgcgctttttgtttctttagataagccaaatgatcgattgaaaattagtggagtagaaattagactacgccaattaggaagaaagctacacttagataggattcatccacataagttcaga

SEQ ID NO: 491 - DNA, 992 bp, Lactobacillus reuteri
ggaaaatcagtaataaagaatacctagcgaagtttttggaagctaaaaaaatggaaggttgctctgatagaacaatcaaatattatcgagttacagttgaacaacttttaaagaaagtagttagaccggtaagaaggattactacagaggaaatgcgtgaatatttggttgattatcaaaagattaataattgtggcaaaacaactattgacaatatcaggcgtaatatttcaagtttcttttcctggcttgaggaagaagactatatattaaagagtcctatgcgtcgtattcataaaattcgggctgaaaagcttgtgaagaatgtaataactgatgaagatattgaaaaacttcgtgatggttgttcttgtttaagagatgtagctataatcgatttattgtattcaacgggtataagagttggggaattggttagacttaacagaactgatattaatttttctgaacgtgagtgtgttgtgtttggaaaaggagataaagaaaggcgagtatattttgatgctaagtcaaaagtgcatttgattaattacttaaggagtagaaatgatgataatcctgcgctttttgtttctttagataagccaaatgatcgattgaaaattagtggagtagaaattagactacgccaattaggaagaaagctacacttagataggattcatccacataagttcagacgaagtatggcgacaagagctattgataaaggtatgccaattgaacaagttcaaaagattttaggtcattctcagatagacactacaatgcaatacgctattgttaatcaaaataatgtgaaagcagcacatcgaaaatatatatcctagcaaattcaggtttgtagggtgaattttgatagtgaaacttaaagatgtttgtataaaaggtacatcaaatatcaggcaaaaagatgtaaatgatagtggaagatatcctgtctatggagcagctggtccagtgggctttat

SEQ ID NO: 492 - DNA, 998 bp, Lactobacillus reuteri
aaactttgttcaacaagtcgacaaatcaaaatttgaaaatatagtatacttaaataaaacgctcttaaacaaaattcttagtcaaataggagatgttatccgtgactaactttgattatttactagaagaaccacaatttaaagatttcgtgcaaatagcaatagcagctgaaaaagtagccgttattgatcctgcaacagcagtaattgactgtcgacgtgcaatggaattagcggttaagtggatgtattcagttgactcagacttaagaactccctatcaggataaattagtaaccttaatcaatactctagattttaaggatattgttgatcctaatacttggcaaggcctagaattaattcgtcgtttaggaaatattgctgtacacactaatagaaaagtatctctagatgaagctattttatgtttaaaagctttatttagcttttttgatatgcttgattattgttatggaagcaattatcaaaagaaagattttgacaagtcgattgttgggaattatcgtctggagtttgttcctaaagtctctccaatggaagagtcaacaatttctctcgaaaaacttacgaaaaagaacaaacctttacaggaatctttaactgcgcaaagaaaagtacaaggaaagagctatactcctaaaccatttggaatctcagagtttaaaactcgtaaaatttatattgatactatgctagctgaagtaggttggattgagggccaaaattggttaaacgaagtagaacttaaaggaatgcctaacaaagctggtactggatatgccgattacgtcttatatgatgatgcgcatcaacctcttgcagttattgaggcaaagaaaacttgtaaagatgtagcagttgggcgccaacaagcaaaactatatgcggatatattagagaataagtatggacgtagaccagttatatttttaagtaatggatttgaaacacgaattattgataatcaataccct

SEQ ID NO: 493 - DNA, 22 bp, Lactobacillus reuteri
tcaccctacaaacctgaatttg

SEQ ID NO: 494 - DNA, 18 bp, Lactobacillus reuteri
ttttgatttgtcgacttg

SEQ ID NO: 495 - DNA, 90 bp, Artificial Sequence
  ARTIFICIAL DNA PRIMER
tctatttctacattcggactagtataactagcacttttgtagaaagcttagcctacttcatcaagacatcttaaagcaatgccctctata

SEQ ID NO: 496 - DNA, 26 bp, Artificial Sequence
  ARTIFICIAL DNA PRIMER
gaaatactgatgattcgtccgataga

SEQ ID NO: 497 - DNA, 29 bp, Artificial Sequence
  ARTIFICIAL DNA PRIMER
tagtataactagcacttttgtagaaagct

SEQ ID NO: 498 - DNA, 30 bp, Artificial Sequence
  ARTIFICIAL DNA PRIMER
ttataagtagaaaattgggcaaaagcttgt

SEQ ID NO: 499 - protein, 19 aa, Artificial Sequence
  ARTIFICIAL PRIMER
MAGNSSNFIHKIKQIFTHR

SEQ ID NO: 500 - DNA, 90 bp, Artificial Sequence
  ARTIFICIAL DNA PRIMER
gaccacgtaaagtttttacatgacagcaattcgtgccgtaacggaattcaaattgtcgatgattggttgttggttaataattgcggacct

SEQ ID NO: 501 - DNA, 26 bp, Artificial Sequence
  ARTIFICIAL DNA PRIMER
atttgttgtgtggactatgtacgttg

SEQ ID NO: 502 - DNA, 23 bp, Artificial Sequence
  ARTIFICIAL DNA PRIMER
gcaattcgtgccgtaacggaatt

SEQ ID NO: 503 - DNA, 26 bp, Artificial Sequence
  ARTIFICIAL DNA PRIMER
tggttttaatttttccggttgcgtca

SEQ ID NO: 504 - DNA, 20 bp, Artificial Sequence
  ARTIFICIAL DNA PRIMER
caatgatctagactcgagga

SEQ ID NO: 505 - DNA, 20 bp, Artificial Sequence
  ARTIFICIAL DNA PRIMER
gacgtaccatggctaaaatc

SEQ ID NO: 506 - DNA, 182 bp, Escherichia coli
aagcttatcgatagcgctatagttgttgacagaatggacatactatgatatattgttgctatagcgtacttagctggccagcatatatgtattctataaaatactattacaaggagattttagccatggaattcgcatgcggatccgcggccgcggtacccgggcgcgcctctagaaagctt

SEQ ID NO: 507 - DNA, 182 bp, Escherichia coli
aagcttatcgatcggggtttagttgttgacagggaggcttcgttgtgataagatggtagtatagcgtacttagctggccagcatatatgtattctataaaatactattacaaggagattttagccatggaattcgcatgcggatccgcggccgcggtacccgggcgcgcctctagaaagctt

SEQ ID NO: 508 - DNA, 22 bp, Artificial Sequence
  ARTIFICIAL DNA PRIMER
gcgatggttaaacaacaaaatg

SEQ ID NO: 509 - DNA, 23 bp, Artificial Sequence
  ARTIFICIAL DNA PRIMER
ccacaataaatcacctctttctg

SEQ ID NO: 510 - DNA, 30 bp, Artificial Sequence
  ARTIFICIAL DNA PRIMER
gactgaattcaatcatcgacaatttggcaa

SEQ ID NO: 511 - DNA, 39 bp, Artificial Sequence
  ARTIFICIAL DNA PRIMER
gaatggatcccgggctagctaatttttccggttgcgtca

SEQ ID NO: 512 - DNA, 38 bp, Artificial Sequence
  ARTIFICIAL DNA PRIMER
gctagcccgggatccattcgagcaggactagaaagtga

SEQ ID NO: 513 - DNA, 35 bp, Artificial Sequence
  ARTIFICIAL DNA PRIMER
gactctagacggccggcttttttctttggcccaac

SEQ ID NO: 514 - DNA, 1106 bp, Lactobacillus antri
ggtaccactattacaaggagattttagccatgcgtgggttcgcaatgattggccctaacgaaacgggcttcatcgaaaaagatgatccagaaatgggtccacgtgatgcattggtgaaaccgttggccgtcgctccgtgcacttcggacattcacacggtttacgaaaacgcaatcggtccgcgtcacaacatgattcttgggcacgaagcgtgcggtgagattgtcgccgtgggagatgaagttaaggacttcaaagtgggagacaaagtcttagtacccgcagttaccccagattggtctaagctcgaatcacaagcaggatacgcgtcacacagtggtggaatgttagcagggtggaaattctcaaacttcaaagatggggttttcgccacgcgattccacgttaacgatgcagatggtaacctcgcacacttgcctttggggatggaccctggtgaggcttgcatgttaagcgatatgattccgacgggtctacacgcagacgaaatggcaaacgttcaatacggtgacacggttgcagttattggcattgggcctgtcggcttaatggcgcttcgtggtgccgttctgcatggtgccggacgcatcttcgcagtcgggtcacgcccaaagaccatcgaggtagctaaggaatatggcgctacagacatcattgattaccaccagggtgacattgccgatcagattttgaaattgactgacaaccaaggggtcgataaagtcttgattgcgggtggagatacagaacacactttcgaccaggcagctcgtatgacgaaaccaggtggtgcgattagcaacgttgcttacttaaacggtaacgacgtcttgaagattaaggcagccgattggggtgtcgggatgtcgaacatcacgattgatggtggcttaatgcctggtggccgtctccgtatggaaaagctggccagtcttatcactaacggacgtcttgacccgtcgttaatgatcacgcacaaattctacggtttcgagaagattccggatgcactagagcttatgcacaacaaaccagctgatttgattaagcccgttgtttactgcgatgatatcgactagcccggg

SEQ ID NO: 515 - DNA, 853 bp, Lactobacillus plantarum
ccatggcctctttcattgcctccgaccaagacgtcaaaaacttcctcactgctccgagtatgaacgaccaagaaggtattggtttcgcgtacgccactgacgaagctgtgttgaaagcgctcattccagcaccgttgaaattgatggcacctgtcgtttgcgggtacgtcgtccacatgggtaagccaactttcagtgctccgtacctggaagaaagtctgttcgcattggtgtcctacaaagacaaaatgatgggtgcatacccgattaacctcctactccacggtccaggtgcggagtcgggtgtcattgcaggacgtgagggagcaggcattccgaagaaactggctgacgacattgagcttcgccgaaacgacaacagcgctaccgctaccgttgagcgtcacggtaaaactctcttaaacgttagttggactgcaggagaacttaacgacccaagcattatgaagcagtttgcgggtcagttagccttaggcaaggaagccgaaatgaactcattcttctacaagtacgacattgaccaacacgaagacggcacgaaccacttcagcaacgtgcaactagttgcaacgcagttgcgcagtctggcagaccaggtagaacccggtaaccttagcatccagctcgaaagtactgacgacgacccgttcggcgagttgaaagttttgaaacctctgggtgcagcgtggttccacttcgacacctccgtcatgttcaacacgctaaaacttgacgaggttgacgctgccacgaccatgccaaaactgttaacgggtcgttacgaccgttccttcttcaacccgaaagccgctacgtacatcatttaggtacc

SEQ ID NO: 516 - DNA, 78 bp, Artificial Sequence
  ARTIFICIAL DNA PRIMER
  misc_feature (12)..(19): n is a, c, g, or t
  misc_feature (31)..(44): n is a, c, g, or t
  misc_feature (52)..(52): n is a, c, g, or t
  misc_feature (54)..(58): n is a, c, g, or t
cccatgtcgacnnnnnnnnagttgttgacannnnnnnnnnnnnntgrtawdntnnnnntatagcgtacttagctggcc

SEQ ID NO: 517 - DNA, 18 bp, Artificial Sequence
  ARTIFICIAL DNA PRIMER
gctatcaatcaaagcaac

SEQ ID NO: 518 - DNA, 73 bp, Escherichia coli
gtcgacccggaagtagttgttgacacgcacctgcttgtgtgataaattaaatttatagcgtacttagctggcc

What is claimed is:

1. A mutant of a parent *Lactobacillus* strain, comprising a disruption to an endogenous gene encoding a type I restriction modification system subunit.

2. The mutant of claim 1, wherein the disruption is of an endogenous gene encoding a restriction subunit of a type I restriction modification system.

3. The mutant of claim 2, wherein the restriction subunit has at least 90% sequence identity to SEQ ID NO: 8 or SEQ ID NO: 16.

4. The mutant of claim 1, wherein the disruption is of an endogenous gene encoding a specificity subunit of a type I restriction modification system.

5. The mutant of claim 4, wherein the specificity subunit has at least 90% sequence identity to SEQ ID NO: 2, 4, 6, 12, or 14.

6. The mutant of claim 1, wherein the disruption occurs in the coding sequence of the gene encoding the type I restriction modification system subunit.

7. The mutant of claim 1, wherein the mutant produces at least 25% less of the type I restriction modification system subunit encoded by the disrupted gene compared to the parent *Lactobacillus* strain when cultivated under identical conditions.

8. The mutant of claim 1, wherein the endogenous gene encoding the type I restriction modification system subunit is inactivated.

9. The mutant of claim 1, further comprising a disruption to an endogenous gene encoding a non-type I restriction modification system protein.

10. The mutant of claim 9, wherein the non-type I restriction modification system protein has at least 90% sequence identity to SEQ ID NO: 20 or SEQ ID NO: 22.

11. The mutant of claim 9, wherein the disruption occurs in the coding sequence of the gene encoding the non-type I restriction modification system protein.

12. The mutant of claim 9, wherein the mutant produces at least 25% less of the non-type I restriction modification system protein encoded by the disrupted gene compared to the parent *Lactobacillus* strain when cultivated under identical conditions.

13. The mutant of claim 9, wherein the endogenous gene encoding the non-type I restriction modification system protein is inactivated.

14. The mutant of claim 1, wherein the mutant has improved transformation efficiency compared to the parent *Lactobacillus* strain when cultivated under identical conditions.

15. The mutant of claim 1, wherein the mutant is capable of producing at least 10-fold more transformants compared to the parent *Lactobacillus* strain when transformed and cultivated under identical conditions.

16. The mutant of claim 1, wherein the *Lactobacillus* strain is selected from *Lactobacillus fructivorans*, *Lactobacillus plantarum*, and *Lactobacillus reuteri*.

17. A method of producing a polypeptide, comprising cultivating a mutant of claim 1, which comprises a heterologous polynucleotide encoding the polypeptide.

18. A method of producing a polypeptide, comprising cultivating a mutant of claim 2, which comprises a heterologous polynucleotide encoding the polypeptide.

19. A method of producing a polypeptide, comprising cultivating a mutant of claim 3, which comprises a heterologous polynucleotide encoding the polypeptide.

20. The method of claim 17, further comprising recovering the polypeptide.

* * * * *